United States Patent 12,097,253 (RSV RNA MOLECULES AND COMPOSITIONS FOR VACCINATION) - sequence listing, part 13

SEQ ID NO: 17824 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut6 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17825 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut6 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17826 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut6 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17827 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut6 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17828 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut6 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17829 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut6 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17830 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut6 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17831 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut6 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17832 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut6 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17833 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut6 (opt2)
  source 1..1910: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17834 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut6 (opt3)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17835 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut6 (opt4)
  source 1..1910: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17836 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut6 (opt5)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17837 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut6 (opt6)
  source 1..1910: mol_type = other RNA
gggagagcggctcggccattttgtcccagtcagtccggaggctgcggctgcagaagtaccgcctgcggagtaactgcaaagaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17838 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut6 (opt11)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17839 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut6 (opt1)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17840 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut6 (opt1)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17841 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut6 (opt2)
  source 1..1977: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17842 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut6 (opt3)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17843 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut6 (opt4)
  source 1..1977: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17844 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut6 (opt5)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17845 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut6 (opt6)
  source 1..1977: mol_type = other RNA
gggagagcggctcggccattttgtcccagtcagtccggaggctgcggctgcagaagtaccgcctgcggagtaactgcaaagaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17846 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut6 (opt11)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17847 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut6 (opt1)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17848 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut6 (opt1)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17849 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut6 (opt2)
  source 1..2193: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17850 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut6 (opt3)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17851 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut6 (opt4)
  source 1..2193: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17852 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut6 (opt5)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17853 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut6 (opt6)
  source 1..2193: mol_type = other RNA
gggagagcggctcggccattttgtcccagtcagtccggaggctgcggctgcagaagtaccgcctgcggagtaactgcaaagaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17854 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut6 (opt11)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17855 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut6 (opt1)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17856 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut6 (opt1)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17857 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut6 (opt2)
  source 1..1973: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17858 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut6 (opt3)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17859 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut6 (opt4)
  source 1..1973: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17860 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut6 (opt5)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17861 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut6 (opt6)
  source 1..1973: mol_type = other RNA
gggagagcggctcggccattttgtcccagtcagtccggaggctgcggctgcagaagtaccgcctgcggagtaactgcaaagaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17862 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut6 (opt11)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17863 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut6 (opt1)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17864 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut6 (opt1)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17865 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut6 (opt2)
  source 1..1964: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17866 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut6 (opt3)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17867 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut6 (opt4)
  source 1..1964: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17868 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut6 (opt5)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17869 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut6 (opt6)
  source 1..1964: mol_type = other RNA
gggagagtcccgcagtcggcgtccagcggctctgcttgttcgtgtgtgtgtcgttgcaggccttattcaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17870 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut6 (opt11)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17871 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut6 (opt1)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17872 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut6 (opt1)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17873 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut6 (opt2)
  source 1..2180: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17874 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut6 (opt3)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17875 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut6 (opt4)
  source 1..2180: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17876 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut6 (opt5)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17877 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut6 (opt6)
  source 1..2180: mol_type = other RNA
gggagagtcccgcagtcggcgtccagcggctctgcttgttcgtgtgtgtgtcgttgcaggccttattcaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17878 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut6 (opt11)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17879 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut6 (opt1)
  source 1..1956: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17880 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut6 (opt1)
  source 1..1956: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17881 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut6 (opt2)
  source 1..1956: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17882 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut6 (opt3)
  source 1..1956: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17883 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut6 (opt4)
  source 1..1956: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17884 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut6 (opt5)
  source 1..1956: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17885 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut6 (opt6)
  source 1..1956: mol_type = other RNA
gggagactttcccattctgtagcagaatttggtgttgcctgtggtcttggtcccgcggagaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17886 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut6 (opt11)
  source 1..1956: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17887 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut6 (opt1)
  source 1..1952: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17888 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut6 (opt1)
  source 1..1952: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17889 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut6 (opt2)
  source 1..1952: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17890 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut6 (opt3)
  source 1..1952: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17891 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut6 (opt4)
  source 1..1952: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17892 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut6 (opt5)
  source 1..1952: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17893 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut6 (opt6)
  source 1..1952: mol_type = other RNA
gggagactttcccattctgtagcagaatttggtgttgcctgtggtcttggtcccgcggagaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17894 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut6 (opt11)
  source 1..1952: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17895 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut6 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17896 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut6 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17897 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut6 (opt2)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17898 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut6 (opt3)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17899 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut6 (opt4)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17900 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut6 (opt5)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17901 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut6 (opt6)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17902 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut6 (opt11)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17903 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut6 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17904 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut6 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17905 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut6 (opt2)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17906 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut6 (opt3)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17907 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut6 (opt4)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17908 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut6 (opt5)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17909 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut6 (opt6)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17910 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut6 (opt11)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17911 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut6 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17912 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut6 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17913 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut6 (opt2)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17914 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut6 (opt3)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17915 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut6 (opt4)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17916 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut6 (opt5)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17917 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut6 (opt6)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17918 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut6 (opt11)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17919 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut6 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17920 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut6 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17921 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut6 (opt2)
  source 1..1970: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17922 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut6 (opt3)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17923 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut6 (opt4)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17924 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut6 (opt5)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17925 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut6 (opt6)
  source 1..1970: mol_type = other RNA
gggagacccgtgacccggaagttgtacggctacgcgactttccctcccacaaaccctcgcgcccttcctttcctacttgggcccggcagaaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17926 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut6 (opt11)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17927 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut6 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17928 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut6 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17929 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut6 (opt2)
  source 1..1986: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17930 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut6 (opt3)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17931 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut6 (opt4)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17932 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut6 (opt5)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17933 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut6 (opt6)
  source 1..1986: mol_type = other RNA
gggagacccgtgacccggaagttgtacggctacgcgactttccctcccacaaaccctcgcgcccttcctttcctacttgggcccggcagaaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17934 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut6 (opt11)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17935 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut6 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17936 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut6 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17937 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut6 (opt2)
  source 1..2202: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17938 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut6 (opt3)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17939 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut6 (opt4)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17940 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut6 (opt5)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17941 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut6 (opt6)
  source 1..2202: mol_type = other RNA
gggagacccgtgacccggaagttgtacggctacgcgactttccctcccacaaaccctcgcgcccttcctttcctacttgggcccggcagaaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17942 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut6 (opt11)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17943 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut6 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17944 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut6 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17945 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut6 (opt2)
  source 1..1982: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17946 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut6 (opt3)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17947 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut6 (opt4)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17948 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut6 (opt5)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17949 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut6 (opt6)
  source 1..1982: mol_type = other RNA
gggagacccgtgacccggaagttgtacggctacgcgactttccctcccacaaaccctcgcgcccttcctttcctacttgggcccggcagaaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17950 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut6 (opt11)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17951 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut6 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17952 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut6 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17953 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut6 (opt2)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17954 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut6 (opt3)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17955 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut6 (opt4)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17956 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut6 (opt5)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17957 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut6 (opt6)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17958 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut6 (opt11)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17959 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut6 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17960 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut6 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17961 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut6 (opt2)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17962 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut6 (opt3)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17963 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut6 (opt4)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17964 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut6 (opt5)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17965 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut6 (opt6)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17966 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut6 (opt11)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17967 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut6 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17968 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut6 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17969 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut6 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17970 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut6 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17971 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut6 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17972 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut6 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17973 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut6 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17974 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut6 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17975 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut6 (opt1)
  source 1..1994: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17976 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut6 (opt1)
  source 1..1994: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17977 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut6 (opt2)
  source 1..1994: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17978 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut6 (opt3)
  source 1..1994: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17979 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut6 (opt4)
  source 1..1994: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17980 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut6 (opt5)
  source 1..1994: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17981 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut6 (opt6)
  source 1..1994: mol_type = other RNA
gggagaggcgctgcctacggaggtggcagccatctccttctcggcatcaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17982 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut6 (opt11)
  source 1..1994: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17983 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut6 (opt1)
  source 1..1990: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17984 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut6 (opt1)
  source 1..1990: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17985 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut6 (opt2)
  source 1..1990: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17986 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut6 (opt3)
  source 1..1990: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17987 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut6 (opt4)
  source 1..1990: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17988 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut6 (opt5)
  source 1..1990: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17989 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut6 (opt6)
  source 1..1990: mol_type = other RNA
ggggcgctgcctacggaggtggcagccatctccttctcggcatcaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17990 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut6 (opt11)
  source 1..1990: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17991 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut6 (opt1)
  source 1..1825: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17992 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut6 (opt1)
  source 1..1825: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggagcacgcccgtgaccctgtccaaggaccagctgagcgggatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17993 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut6 (opt2)
  source 1..1825: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17994 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut6 (opt3)
  source 1..1825: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtccaccccagtcacattgtcaaaggatcagctgagtggcataaataacatcgctttctctaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17995 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut6 (opt4)
  source 1..1825: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17996 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut6 (opt5)
  source 1..1825: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctccacccctgtgacactgagcaaggatcagctttctgggattaataacatcgcgttctccaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17997 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut6 (opt6)
  source 1..1825: mol_type = other RNA
gggagaaagcttaccatggaactaccaattttaaaaacaaacgcaattacaactatactcgcagcagtaacattatgtttcgcctcatcccaaaacataacagaagaattttaccaatcaacatgcagcgcagtatcaaaaggatatctcggagcattacgaacaggttggtacacatctgtaatcactatagaactatcaaacataaaagaaaacaaatgcaatggaaccgacgcaaaagtaaaattaataaaacaagaactcgataaatacaaaaatgcagtaacagacctccaaatgctcatgtgttcaacaccagccgcaggatcaggttccgccatagcatctggcatagcagtatgcaaagtactccacttagaaggagaagttaacaaaataaaaaacgcactattatcaacaaacaaagcagtagtatccctctcaaacggagtctcagtattaacattcaaagtattagacctaaaaaactacatagacaaacaactacttccaatactcaacaaacaatcatgctcaataccaaacccagaaaccgtaatggaatttcaacaaaaaaacaaccgactactagaaatcacacgagaattttcagtaaacgccggtgtcacaactccagtatcaacttatatgttaaccaactcagaactattatcattaataaacgatatgcccataactaacgaccaaaaaaaattaatgtcaaacaacgtacaaatagtacgccaacaaagttactcaataatgtgcatcataaaagaagaagtattagcgtacgttgtacaactacctctatacggagtcatagacacaccatgctggaaacttcacacatcaccactatgtacaacaaacacaaaagaaggcagtaacatatgcctaacaagaacagaccgtggatggtattgtgacaacgctggatctgtatcattcttccctcaagcagaaacctgtaaagtttgctcaaacagagtcttctgtgacacaatgaactctctaacactaccttccgaagtgaacctctgtaacatagacatattcaatccaaaatatgattgcaaaataatgacttcaaaaacagatgtatcatcctctgttataacatcattaggcgccatagtttcatgctacggaaaaactaaatgcacagcatcaaacaaaaacaaaggaataataaaaaccttctcaaatggatgcgactacgtaagcaacaaaggcgtagacacagtatcagtaggtaatacattatactacgtaaacaaacaagaaggacaatcactttatgttaaaggagaacctataataaacttctacgacccacttgtatttccatccgatgaatttgacgcatctatatcacaagtcaacgaaaaaataaaccaatcattagcattcattcgaaaatccgatgaactactccataacgtaaatgtcggaaaatcaacaaccaacataatgatcacaacaataatcatagtgataatagtaatactcctactactaatcgcagtaggtctattcctatattgtaaagcaagatctactccagttacactctctaaagaccaattaagcggtatcaacaacatcgccttcagcaattaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17998 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut6 (opt11)
  source 1..1825: mol_type = other RNA
gggagaaagcttaccatggagctgcccatcctcaagaccaacgccatcaccacgatcctggccgcggtgaccctgtgcttcgcgagctcccaaaacatcaccgaggagttctaccagagcacgtgctccgccgtcagcaagggctacctcggggccctgcgcaccggctggtacacctccgtgatcaccatcgagctgagcaacatcaaggaaaacaagtgcaacgggacggacgcaaaggtgaagctcatcaagcaggagctggataagtacaagaacgcggtcacggacctgcagatgctcatgtgctccaccccggccgccggcagcgggtccgccatcgcgtccggcatcgccgtgtgcaaggtgttgcacctggagggcgaggtcaacaagatcaagaacgccctcctttccaccaataaggctgttgtgagcctgtccaacggggtcagcgtgctcaccttcaaggtgctggacctgaagaactacatcgacaagcagctcctgcccatcctgaacaagcagtcctgcagcatccccaaccccgagacagtcatggagttccagcagaagaacaaccggctcctggagatcacccgcgagttctccgttaacgccggggtgaccaccccggtaagcacatacatgctgaccaacagcgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcaactgcccctctacggggtcatcgacaccccctgctggaagctgcacacgtccccgctgtgcaccaccaacaccaaggagggcagcaacatctgcctcacgcgcaccgaccgggggtggtactgcgacaacgcaggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgtaagatcatgaccagcaagaccgatgtctccagctccgtgatcaccagcctgggcgccatagtgtcctgttatgggaagacgaagtgcaccgccagcaacaagaacaaaggcatcatcaagaccttctccaacgggtgcgactacgtcagcaacaagggcgtggacacagtgtccgtcggcaacacgctgtactacgtgaacaagcaggaggggcagagcctctacgtgaagggcgagccgatcatcaacttctacgatcccctggtcttccccagcgacgagttcgacgcgtccatcagccaagtgaacgagaagatcaaccagtccctggccttcatccgcaagagcgacgagctcctgcacaacgtgaacgtcgggaagtccaccaccaacatcatgatcaccaccatcatcatcgtgatcatcgtcatcctgctcctgctgatcgccgtcggcctcttcctgtactgcaaggcccggagcacgcccgtgaccctgtccaaggaccagctgtcgggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17999 - protein, 514 aa, synthetic construct
  REGION 1..514: note = derived and/or modified protein sequence (artificial) from HRSV(Memphis-37)__AIY60640.1__F-del_DSCav1_mut6
MELPILKTNAITTILAAVTLCFASSQNITEEFYQSTCSAVSKGYLGALRTGWYTSVITIELSNIKENKCNGTDAKVKLIKQELDKYKNAVTDLQMLMCSTPAAGSGSAIASGIAVCKVLHLEGEVNKIKNALLSTNKAVVSLSNGVSVLTFKVLDLKNYIDKQLLPILNKQSCSIPNPETVMEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVCSNRVFCDTMNSLTLPSEVNLCNIDIFNPKYDCKIMTSKTDVSSSVITSLGAIVSCYGKTKCTASNKNKGIIKTFSNGCDYVSNKGVDTVSVGNTLYYVNKQEGQSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 18000 - RNA, 1545 nt, synthetic construct
  misc_feature 1..1545: note = derived and/or modified CDS sequence (opt1) from HRSV(Memphis-37)__AIY60640.1__F-del_DSCav1_mut6
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctga

SEQ ID NO: 18001 - RNA, 1545 nt, synthetic construct
  misc_feature 1..1545: note = derived and/or modified CDS sequence (opt1) from HRSV(Memphis-37)__AIY60640.1__F-del_DSCav1_mut6
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtga

SEQ ID NO: 18002 - RNA, 1545 nt, synthetic construct
  misc_feature 1..1545: note = derived and/or modified CDS sequence (opt2) from HRSV(Memphis-37)__AIY60640.1__F-del_DSCav1_mut6
  source 1..1545: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctga

SEQ ID NO: 18003 - RNA, 1545 nt, synthetic construct
  misc_feature 1..1545: note = derived and/or modified CDS sequence (opt3) from HRSV(Memphis-37)__AIY60640.1__F-del_DSCav1_mut6
  source 1..1545: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtga

SEQ ID NO: 18004 - RNA, 1545 nt, synthetic construct
  misc_feature 1..1545: note = derived and/or modified CDS sequence (opt4) from HRSV(Memphis-37)__AIY60640.1__F-del_DSCav1_mut6
  source 1..1545: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatga

SEQ ID NO: 18005 - RNA, 1545 nt, synthetic construct
  misc_feature 1..1545: note = derived and/or modified CDS sequence (opt5) from HRSV(Memphis-37)__AIY60640.1__F-del_DSCav1_mut6
  source 1..1545: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctga

SEQ ID NO: 18006 - RNA, 1545 nt, synthetic construct
  misc_feature 1..1545: note = derived and/or modified CDS sequence (opt6) from HRSV(Memphis-37)__AIY60640.1__F-del_DSCav1_mut6
  source 1..1545: mol_type = other RNA
atggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataa

SEQ ID NO: 18007 - RNA, 1545 nt, synthetic construct
  misc_feature 1..1545: note = derived and/or modified CDS sequence (opt11) from HRSV(Memphis-37)__AIY60640.1__F-del_DSCav1_mut6
  source 1..1545: mol_type = other RNA
atggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaa

SEQ ID NO: 18008 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut6 (opt1)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18009 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut6 (opt1)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18010 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut6 (opt2)
  source 1..1821: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18011 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut6 (opt3)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18012 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut6 (opt4)
  source 1..1821: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18013 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut6 (opt5)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18014 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut6 (opt6)
  source 1..1821: mol_type = other RNA
gggagagtcccgcagtcggcgtccagcggctctgcttgttcgtgtgtgtgtcgttgcaggccttattcaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18015 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut6 (opt11)
  source 1..1821: mol_type = other RNA
gggagagtcccgcagtcggcgtccagcggctctgcttgttcgtgtgtgtgtcgttgcaggccttattcaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18016 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut6 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18017 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut6 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18018 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut6 (opt2)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18019 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut6 (opt3)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18020 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut6 (opt4)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18021 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut6 (opt5)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18022 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut6 (opt6)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18023 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut6 (opt11)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18024 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut6 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18025 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut6 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18026 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut6 (opt2)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18027 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut6 (opt3)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18028 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut6 (opt4)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18029 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut6 (opt5)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18030 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut6 (opt6)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18031 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut6 (opt11)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18032 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut6 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18033 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut6 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18034 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut6 (opt2)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18035 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut6 (opt3)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18036 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut6 (opt4)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18037 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut6 (opt5)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18038 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut6 (opt6)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18039 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut6 (opt11)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18040 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut6 (opt1)
  source 1..1813: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18041 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut6 (opt1)
  source 1..1813: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18042 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut6 (opt2)
  source 1..1813: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18043 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut6 (opt3)
  source 1..1813: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18044 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut6 (opt4)
  source 1..1813: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18045 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut6 (opt5)
  source 1..1813: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18046 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut6 (opt6)
  source 1..1813: mol_type = other RNA
gggagactttcccattctgtagcagaatttggtgttgcctgtggtcttggtcccgcggagaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18047 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut6 (opt11)
  source 1..1813: mol_type = other RNA
gggagactttcccattctgtagcagaatttggtgttgcctgtggtcttggtcccgcggagaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18048 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut6 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18049 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut6 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18050 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut6 (opt2)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18051 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut6 (opt3)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18052 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut6 (opt4)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18053 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut6 (opt5)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18054 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut6 (opt6)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18055 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut6 (opt11)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18056 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut6 (opt1)
  source 1..1814: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18057 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut6 (opt1)
  source 1..1814: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18058 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut6 (opt2)
  source 1..1814: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18059 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut6 (opt3)
  source 1..1814: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18060 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut6 (opt4)
  source 1..1814: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18061 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut6 (opt5)
  source 1..1814: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18062 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut6 (opt6)
  source 1..1814: mol_type = other RNA
gggagagcctctgctggagtccggggagtggcgttggctgctagagcgaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18063 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut6 (opt11)
  source 1..1814: mol_type = other RNA
gggagagcctctgctggagtccggggagtggcgttggctgctagagcgaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18064 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut6 (opt1)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18065 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut6 (opt1)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18066 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut6 (opt2)
  source 1..1834: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18067 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut6 (opt3)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18068 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut6 (opt4)
  source 1..1834: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18069 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut6 (opt5)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18070 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut6 (opt6)
  source 1..1834: mol_type = other RNA
gggagagtcccgcagtcggcgtccagcggctctgcttgttcgtgtgtgtgtcgttgcaggccttattcaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18071 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut6 (opt11)
  source 1..1834: mol_type = other RNA
gggagagtcccgcagtcggcgtccagcggctctgcttgttcgtgtgtgtgtcgttgcaggccttattcaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18072 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut6 (opt1)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18073 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut6 (opt1)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18074 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut6 (opt2)
  source 1..1885: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18075 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut6 (opt3)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18076 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut6 (opt4)
  source 1..1885: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18077 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut6 (opt5)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18078 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut6 (opt6)
  source 1..1885: mol_type = other RNA
gggagagtcccgcagtcggcgtccagcggctctgcttgttcgtgtgtgtgtcgttgcaggccttattcaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18079 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut6 (opt11)
  source 1..1885: mol_type = other RNA
gggagagtcccgcagtcggcgtccagcggctctgcttgttcgtgtgtgtgtcgttgcaggccttattcaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18080 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut6 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18081 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut6 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18082 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut6 (opt2)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18083 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut6 (opt3)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18084 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut6 (opt4)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18085 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut6 (opt5)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18086 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut6 (opt6)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18087 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut6 (opt11)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18088 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut6 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18089 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut6 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18090 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut6 (opt2)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18091 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut6 (opt3)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18092 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut6 (opt4)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18093 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut6 (opt5)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18094 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut6 (opt6)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18095 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut6 (opt11)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18096 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut6 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18097 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut6 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18098 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut6 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18099 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut6 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18100 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut6 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18101 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut6 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18102 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut6 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18103 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut6 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18104 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut6 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18105 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut6 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18106 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut6 (opt2)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18107 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut6 (opt3)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18108 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut6 (opt4)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18109 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut6 (opt5)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18110 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut6 (opt6)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18111 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut6 (opt11)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18112 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut6 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18113 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut6 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18114 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut6 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18115 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut6 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18116 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut6 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18117 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut6 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18118 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut6 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18119 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut6 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18120 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut6 (opt1)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18121 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut6 (opt1)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18122 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut6 (opt2)
  source 1..1834: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18123 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut6 (opt3)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18124 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut6 (opt4)
  source 1..1834: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18125 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut6 (opt5)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18126 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut6 (opt6)
  source 1..1834: mol_type = other RNA
gggagagcggctcggccattttgtcccagtcagtccggaggctgcggctgcagaagtaccgcctgcggagtaactgcaaagaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18127 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut6 (opt11)
  source 1..1834: mol_type = other RNA
gggagagcggctcggccattttgtcccagtcagtccggaggctgcggctgcagaagtaccgcctgcggagtaactgcaaagaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18128 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut6 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18129 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut6 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18130 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut6 (opt2)
  source 1..1843: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18131 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut6 (opt3)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18132 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut6 (opt4)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18133 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut6 (opt5)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18134 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut6 (opt6)
  source 1..1843: mol_type = other RNA
gggagacccgtgacccggaagttgtacggctacgcgactttccctcccacaaaccctcgcgcccttcctttcctacttgggcccggcagaaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18135 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut6 (opt11)
  source 1..1843: mol_type = other RNA
gggagacccgtgacccggaagttgtacggctacgcgactttccctcccacaaaccctcgcgcccttcctttcctacttgggcccggcagaaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18136 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut6 (opt1)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18137 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut6 (opt1)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18138 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut6 (opt2)
  source 1..1898: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18139 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut6 (opt3)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18140 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut6 (opt4)
  source 1..1898: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18141 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut6 (opt5)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18142 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut6 (opt6)
  source 1..1898: mol_type = other RNA
gggagagcggctcggccattttgtcccagtcagtccggaggctgcggctgcagaagtaccgcctgcggagtaactgcaaagaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18143 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut6 (opt11)
  source 1..1898: mol_type = other RNA
gggagagcggctcggccattttgtcccagtcagtccggaggctgcggctgcagaagtaccgcctgcggagtaactgcaaagaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18144 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut6 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18145 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut6 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18146 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut6 (opt2)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18147 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut6 (opt3)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18148 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut6 (opt4)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18149 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut6 (opt5)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18150 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut6 (opt6)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18151 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut6 (opt11)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18152 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut6 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18153 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut6 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18154 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut6 (opt2)
  source 1..1897: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18155 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut6 (opt3)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18156 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut6 (opt4)
  source 1..1897: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18157 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut6 (opt5)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18158 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut6 (opt6)
  source 1..1897: mol_type = other RNA
gggagagtcccgcagtcggcgtccagcggctctgcttgttcgtgtgtgtgtcgttgcaggccttattcaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18159 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut6 (opt11)
  source 1..1897: mol_type = other RNA
gggagagtcccgcagtcggcgtccagcggctctgcttgttcgtgtgtgtgtcgttgcaggccttattcaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18160 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut6 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18161 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut6 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18162 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut6 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18163 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut6 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18164 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut6 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18165 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut6 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18166 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut6 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18167 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut6 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18168 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut6 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18169 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut6 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18170 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut6 (opt2)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18171 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut6 (opt3)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18172 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut6 (opt4)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18173 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut6 (opt5)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18174 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut6 (opt6)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18175 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut6 (opt11)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18176 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut6 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18177 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut6 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18178 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut6 (opt2)
  source 1..1856: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18179 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut6 (opt3)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18180 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut6 (opt4)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18181 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut6 (opt5)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18182 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut6 (opt6)
  source 1..1856: mol_type = other RNA
gggagacccgtgacccggaagttgtacggctacgcgactttccctcccacaaaccctcgcgcccttcctttcctacttgggcccggcagaaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18183 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut6 (opt11)
  source 1..1856: mol_type = other RNA
gggagacccgtgacccggaagttgtacggctacgcgactttccctcccacaaaccctcgcgcccttcctttcctacttgggcccggcagaaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18184 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut6 (opt1)
  source 1..1826: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18185 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut6 (opt1)
  source 1..1826: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18186 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut6 (opt2)
  source 1..1826: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18187 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut6 (opt3)
  source 1..1826: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18188 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut6 (opt4)
  source 1..1826: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18189 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut6 (opt5)
  source 1..1826: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18190 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut6 (opt6)
  source 1..1826: mol_type = other RNA
gggagactttcccattctgtagcagaatttggtgttgcctgtggtcttggtcccgcggagaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18191 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut6 (opt11)
  source 1..1826: mol_type = other RNA
gggagactttcccattctgtagcagaatttggtgttgcctgtggtcttggtcccgcggagaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18192 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut6 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18193 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut6 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18194 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut6 (opt2)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18195 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut6 (opt3)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18196 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut6 (opt4)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18197 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut6 (opt5)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18198 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut6 (opt6)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18199 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut6 (opt11)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18200 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut6 (opt1)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18201 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut6 (opt1)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18202 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut6 (opt2)
  source 1..1847: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18203 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut6 (opt3)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18204 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut6 (opt4)
  source 1..1847: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18205 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut6 (opt5)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18206 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut6 (opt6)
  source 1..1847: mol_type = other RNA
gggagagcggctcggccattttgtcccagtcagtccggaggctgcggctgcagaagtaccgcctgcggagtaactgcaaagaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18207 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut6 (opt11)
  source 1..1847: mol_type = other RNA
gggagagcggctcggccattttgtcccagtcagtccggaggctgcggctgcagaagtaccgcctgcggagtaactgcaaagaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18208 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut6 (opt1)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18209 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut6 (opt1)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18210 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut6 (opt2)
  source 1..1914: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18211 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut6 (opt3)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18212 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut6 (opt4)
  source 1..1914: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18213 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut6 (opt5)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18214 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut6 (opt6)
  source 1..1914: mol_type = other RNA
gggagagcggctcggccattttgtcccagtcagtccggaggctgcggctgcagaagtaccgcctgcggagtaactgcaaagaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18215 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut6 (opt11)
  source 1..1914: mol_type = other RNA
gggagagcggctcggccattttgtcccagtcagtccggaggctgcggctgcagaagtaccgcctgcggagtaactgcaaagaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18216 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut6 (opt1)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18217 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut6 (opt1)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18218 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut6 (opt2)
  source 1..2130: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18219 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut6 (opt3)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18220 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut6 (opt4)
  source 1..2130: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18221 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut6 (opt5)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18222 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut6 (opt6)
  source 1..2130: mol_type = other RNA
gggagagcggctcggccattttgtcccagtcagtccggaggctgcggctgcagaagtaccgcctgcggagtaactgcaaagaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18223 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut6 (opt11)
  source 1..2130: mol_type = other RNA
gggagagcggctcggccattttgtcccagtcagtccggaggctgcggctgcagaagtaccgcctgcggagtaactgcaaagaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18224 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut6 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18225 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut6 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18226 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut6 (opt2)
  source 1..1910: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18227 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut6 (opt3)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18228 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut6 (opt4)
  source 1..1910: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18229 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut6 (opt5)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18230 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut6 (opt6)
  source 1..1910: mol_type = other RNA
gggagagcggctcggccattttgtcccagtcagtccggaggctgcggctgcagaagtaccgcctgcggagtaactgcaaagaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18231 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut6 (opt11)
  source 1..1910: mol_type = other RNA
gggagagcggctcggccattttgtcccagtcagtccggaggctgcggctgcagaagtaccgcctgcggagtaactgcaaagaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18232 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut6 (opt1)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18233 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut6 (opt1)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18234 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut6 (opt2)
  source 1..1901: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18235 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut6 (opt3)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18236 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut6 (opt4)
  source 1..1901: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18237 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut6 (opt5)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18238 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut6 (opt6)
  source 1..1901: mol_type = other RNA
gggagagtcccgcagtcggcgtccagcggctctgcttgttcgtgtgtgtgtcgttgcaggccttattcaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18239 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut6 (opt11)
  source 1..1901: mol_type = other RNA
gggagagtcccgcagtcggcgtccagcggctctgcttgttcgtgtgtgtgtcgttgcaggccttattcaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18240 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut6 (opt1)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18241 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut6 (opt1)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18242 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut6 (opt2)
  source 1..2117: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18243 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut6 (opt3)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18244 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut6 (opt4)
  source 1..2117: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18245 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut6 (opt5)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18246 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut6 (opt6)
  source 1..2117: mol_type = other RNA
gggagagtcccgcagtcggcgtccagcggctctgcttgttcgtgtgtgtgtcgttgcaggccttattcaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18247 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut6 (opt11)
  source 1..2117: mol_type = other RNA
gggagagtcccgcagtcggcgtccagcggctctgcttgttcgtgtgtgtgtcgttgcaggccttattcaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18248 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut6 (opt1)
  source 1..1893: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18249 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut6 (opt1)
  source 1..1893: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18250 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut6 (opt2)
  source 1..1893: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18251 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut6 (opt3)
  source 1..1893: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18252 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut6 (opt4)
  source 1..1893: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18253 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut6 (opt5)
  source 1..1893: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18254 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut6 (opt6)
  source 1..1893: mol_type = other RNA
gggagactttcccattctgtagcagaatttggtgttgcctgtggtcttggtcccgcggagaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18255 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut6 (opt11)
  source 1..1893: mol_type = other RNA
gggagactttcccattctgtagcagaatttggtgttgcctgtggtcttggtcccgcggagaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18256 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut6 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18257 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut6 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18258 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut6 (opt2)
  source 1..1889: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18259 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut6 (opt3)
  source 1..1889: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18260 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut6 (opt4)
  source 1..1889: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18261 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut6 (opt5)
  source 1..1889: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18262 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut6 (opt6)
  source 1..1889: mol_type = other RNA
gggagactttcccattctgtagcagaatttggtgttgcctgtggtcttggtcccgcggagaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18263 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut6 (opt11)
  source 1..1889: mol_type = other RNA
gggagactttcccattctgtagcagaatttggtgttgcctgtggtcttggtcccgcggagaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18264 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut6 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18265 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut6 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18266 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut6 (opt2)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18267 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut6 (opt3)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18268 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut6 (opt4)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18269 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut6 (opt5)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18270 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut6 (opt6)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18271 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut6 (opt11)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18272 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut6 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18273 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut6 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18274 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut6 (opt2)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18275 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut6 (opt3)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18276 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut6 (opt4)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18277 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut6 (opt5)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18278 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut6 (opt6)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18279 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut6 (opt11)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18280 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut6 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18281 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut6 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18282 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut6 (opt2)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18283 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut6 (opt3)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18284 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut6 (opt4)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18285 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut6 (opt5)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18286 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut6 (opt6)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18287 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut6 (opt11)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18288 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut6 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18289 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut6 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18290 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut6 (opt2)
  source 1..1907: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18291 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut6 (opt3)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18292 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut6 (opt4)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18293 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut6 (opt5)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18294 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut6 (opt6)
  source 1..1907: mol_type = other RNA
gggagacccgtgacccggaagttgtacggctacgcgactttccctcccacaaaccctcgcgcccttcctttcctacttgggcccggcagaaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18295 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut6 (opt11)
  source 1..1907: mol_type = other RNA
gggagacccgtgacccggaagttgtacggctacgcgactttccctcccacaaaccctcgcgcccttcctttcctacttgggcccggcagaaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18296 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut6 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18297 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut6 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18298 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut6 (opt2)
  source 1..1923: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18299 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut6 (opt3)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18300 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut6 (opt4)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18301 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut6 (opt5)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18302 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut6 (opt6)
  source 1..1923: mol_type = other RNA
gggagacccgtgacccggaagttgtacggctacgcgactttccctcccacaaaccctcgcgcccttcctttcctacttgggcccggcagaaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18303 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut6 (opt11)
  source 1..1923: mol_type = other RNA
gggagacccgtgacccggaagttgtacggctacgcgactttccctcccacaaaccctcgcgcccttcctttcctacttgggcccggcagaaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18304 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut6 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18305 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut6 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18306 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut6 (opt2)
  source 1..2139: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18307 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut6 (opt3)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18308 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut6 (opt4)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18309 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut6 (opt5)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18310 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut6 (opt6)
  source 1..2139: mol_type = other RNA
gggagacccgtgacccggaagttgtacggctacgcgactttccctcccacaaaccctcgcgcccttcctttcctacttgggcccggcagaaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18311 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut6 (opt11)
  source 1..2139: mol_type = other RNA
gggagacccgtgacccggaagttgtacggctacgcgactttccctcccacaaaccctcgcgcccttcctttcctacttgggcccggcagaaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18312 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut6 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18313 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut6 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18314 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut6 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18315 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut6 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18316 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut6 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18317 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut6 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18318 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut6 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18319 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut6 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18320 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut6 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18321 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut6 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18322 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut6 (opt2)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18323 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut6 (opt3)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18324 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut6 (opt4)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18325 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut6 (opt5)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18326 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut6 (opt6)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18327 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut6 (opt11)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18328 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut6 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18329 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut6 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18330 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut6 (opt2)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18331 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut6 (opt3)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18332 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut6 (opt4)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18333 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut6 (opt5)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18334 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut6 (opt6)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18335 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut6 (opt11)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18336 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut6 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18337 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut6 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18338 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut6 (opt2)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18339 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut6 (opt3)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18340 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut6 (opt4)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18341 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut6 (opt5)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18342 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut6 (opt6)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18343 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut6 (opt11)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18344 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut6 (opt1)
  source 1..1931: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18345 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut6 (opt1)
  source 1..1931: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18346 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut6 (opt2)
  source 1..1931: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18347 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut6 (opt3)
  source 1..1931: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18348 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut6 (opt4)
  source 1..1931: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18349 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut6 (opt5)
  source 1..1931: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18350 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut6 (opt6)
  source 1..1931: mol_type = other RNA
gggagaggcgctgcctacggaggtggcagccatctccttctcggcatcaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18351 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut6 (opt11)
  source 1..1931: mol_type = other RNA
gggagaggcgctgcctacggaggtggcagccatctccttctcggcatcaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18352 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut6 (opt1)
  source 1..1927: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18353 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut6 (opt1)
  source 1..1927: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18354 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut6 (opt2)
  source 1..1927: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18355 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut6 (opt3)
  source 1..1927: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18356 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut6 (opt4)
  source 1..1927: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18357 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut6 (opt5)
  source 1..1927: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18358 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut6 (opt6)
  source 1..1927: mol_type = other RNA
ggggcgctgcctacggaggtggcagccatctccttctcggcatcaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18359 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut6 (opt11)
  source 1..1927: mol_type = other RNA
ggggcgctgcctacggaggtggcagccatctccttctcggcatcaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18360 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut6 (opt1)
  source 1..1762: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatccccaaccccgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18361 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut6 (opt1)
  source 1..1762: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctcatgtgctccaccccggccgccggcagcgggtccgccatcgcgagcggcatcgccgtgtgcaaggtgctgcacctggagggcgaggtcaacaagatcaagaacgccctcctgtccaccaacaaggccgtggtgagcctgtccaacggggtcagcgtgctcaccttcaaggtgctggacctgaagaactacatcgacaagcagctcctgcccatcctgaacaagcagtcctgcagcatccccaaccccgagacggtcatggagttccagcagaagaacaaccggctcctggagatcacccgcgagttctccgtgaacgccggcgtgaccaccccggtcagcacgtacatgctgaccaactccgagctcctgagcctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgcccctctacggggtcatcgacaccccctgctggaagctgcacacgtccccgctgtgcaccaccaacaccaaggagggcagcaacatctgcctcacgcgcaccgaccgggggtggtactgcgacaacgccggctccgtgagcttcttcccccaggccgagacctgcaaggtgtgctccaaccgcgtcttctgcgacaccatgaacagcctgacgctgccctccgaggtgaacctctgcaacatcgacatcttcaaccccaagtacgactgcaagatcatgaccagcaagaccgacgtctccagctccgtgatcaccagcctgggcgccatcgtgtcctgctacgggaagacgaagtgcaccgccagcaacaagaacaagggcatcatcaagaccttctccaacgggtgcgactacgtcagcaacaagggcgtggacaccgtgtccgtcggcaacacgctgtactacgtgaacaagcaggaggggcagagcctctacgtgaagggcgagccgatcatcaacttctacgaccccctggtcttccccagcgacgagttcgacgcgtccatcagccaggtgaacgagaagatcaaccagtccctggccttcatccgcaagagcgacgagctcctgcacaacgtgaacgtcgggaagtccaccaccaacatcatgatcaccaccatcatcatcgtgatcatcgtgatcctgctcctgctgatcgccgtcggcctcttcctgtactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18362 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut6 (opt2)
  source 1..1762: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18363 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut6 (opt3)
  source 1..1762: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagaataaatgcaacggtaccgacgccaaggtgaaactaatcaagcaggaactcgataagtataaaaatgcagtaactgacctgcagatgcttatgtgttctactcctgccgctggctcggggtcagcaatagccagcggaatcgctgtgtgcaaggtcctgcacttggagggcgaggtgaacaaaattaagaatgccctcctgagtaccaacaaagcggttgtgtccctgtctaatggtgtcagcgtgctcacgttcaaggtattagatctgaagaactacatcgacaaacagcttttgccaattctgaataagcaatcctgttcaatcccgaaccccgaaactgttatggagtttcagcagaaaaataacaggctactcgaaataacccgggagttcagtgtgaatgcaggggtcacaactcctgtgagcacctatatgctgacaaactctgagcttctgtccttgattaacgatatgccaatcaccaatgaccagaagaaactcatgtcaaacaatgtgcaaattgtccgccagcagagctacagtatcatgtgcatcattaaggaagaggttctggcctatgtggtacagttacccctgtacggagtgatagatacgccttgttggaaactccatacttctccactttgcacaaccaacactaaggaaggctccaatatctgtctgacacgaaccgaccgtggctggtactgcgataacgctgggagcgtctcgtttttcccccaagccgagacgtgtaaggtgtgctctaatagagttttctgcgacaccatgaactccttgacactaccttcagaagtgaatctgtgtaacattgatatcttcaatccaaaatatgactgcaagataatgacaagtaaaaccgatgtcagctcctctgtgattacaagcctcggagcaatcgtatcatgttacggtaagactaaatgcaccgctagtaacaagaataagggcatcattaaaacattttccaacgggtgtgactatgttagcaataagggagtggacaccgtctctgtgggcaacactctgtactatgtcaacaaacaggagggtcagtcactttacgtgaagggggagccgatcattaatttctatgatcccctggtttttcctagtgacgaatttgatgccagcatatcccaagtgaacgagaaaatcaatcagtctttggcgtttattaggaagtcggacgaactcctgcacaacgtaaatgtcggaaagagcacgacaaacatcatgatcaccactattataatcgtgattatcgttattttactgctactcatcgccgtgggcctgttcctttactgcaaagcacggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18364 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut6 (opt4)
  source 1..1762: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18365 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut6 (opt5)
  source 1..1762: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagaataaatgcaacggcaccgacgccaaggtgaaacttatcaagcaggaactggataagtataaaaatgctgtgacggacctccagatgctgatgtgttccacccctgccgctgggtctggaagcgccattgcgtccggcatcgccgtctgcaaggtgctgcacctcgagggggaggttaacaaaattaagaatgctctgcttagcacaaacaaagccgtggtctctctgtccaatggagtgagcgttctcaccttcaaggtgctggatcttaagaactacatcgacaaacagctgctcccgattctgaataagcaatcttgttccatccccaaccctgaaacagtcatggagtttcagcagaaaaataaccggctgctcgaaattacccgcgagttcagcgtgaatgctggcgtgacgacacccgtctctacctatatgctgacaaactccgagcttctgagcctcatcaacgatatgcctatcaccaatgaccagaagaaactgatgtccaacaatgttcaaattgtgagacagcagtcttacagcatcatgtgcattatcaaggaagaggtgcttgcctatgtcgtgcagctgcccctctacggcgttattgataccccttgttggaaactgcatacatccccgctgtgcacgaccaacacaaaggaagggagcaatatctgtctcacccggacagaccgcggatggtactgcgataacgcgggctctgtgtcctttttcccccaagccgagacctgtaaggtctgcagcaatagagtgttttgcgacacgatgaactctctgacacttcctagcgaagttaatctgtgtaacatcgatattttcaatcccaaatatgactgcaagatcatgacctccaaaaccgatgtgtctagctccgtcattacaagcctcggggctatcgtgtcttgttacggaaagaccaaatgcacagcctccaacaagaataagggcattatcaaaacgtttagcaacgggtgtgactatgtctctaataagggagtggacaccgtttccgtgggcaacacactgtactatgtcaacaaacaggagggccagagcctttacgtgaagggggagcctatcattaatttctatgatcccctggtttttccgtccgacgaatttgatgcttctatcagccaagtgaacgagaaaattaatcagtccctcgccttcatccggaagtctgacgaactgctgcacaacgtcaatgtgggaaagagcaccacaaacattatgatcaccacgattatcatcgtgattatcgttattctcctgcttctgatcgccgtcggcctcttcctgtactgcaaagctcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18366 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut6 (opt6)
  source 1..1762: mol_type = other RNA
gggagaaagcttaccatggaactacctatactaaaaaccaacgccataacaacaatactagccgcagttacactctgctttgcatcctcacaaaacatcacagaggaattttaccaatctacttgctccgcagtatcaaaaggatacctaggagcactccgtacaggatggtacacatcagtcataacaattgaattatctaacatcaaagaaaacaaatgtaatggtacagacgccaaagtaaaattaataaaacaagaactagacaaatacaaaaacgccgtaacagacctacaaatgctaatgtgctcaacccccgccgcaggatctggatcagcaattgcctcaggcatagcagtatgcaaagtcctacacctagaaggagaagtcaacaaaataaaaaacgctctcctctcaaccaataaagcagtagtatccctctcaaacggagtatcagtactaacattcaaagtactagacctcaaaaattatatagacaagcaactactcccaatattaaataaacaatcctgctcaatacccaatccagaaacagtcatggaatttcaacaaaaaaacaaccgactcttagaaataacaagagaattttcagtcaatgccggcgtcacaaccccagtatcaacatacatgctaacaaactcagaactactatcactaatcaacgatatgcccataaccaacgaccaaaaaaaactaatgtcaaacaatgtacaaattgtaagacaacagtcttattcaataatgtgcataataaaagaagaagtcttagcatatgtagtacaactaccactatacggagtaatagacacaccatgttggaaattacacacatccccactatgtaccaccaacacaaaagaaggatctaacatatgcctaaccagaacagaccgaggctggtattgcgacaatgcaggatcagtatccttctttccacaagcagaaacatgcaaagtctgctctaacagagtattctgcgatactatgaactcacttaccttaccatcagaagtaaatctatgtaatatcgacatattcaatcccaaatatgattgcaaaataatgacctcaaaaacagatgtatcatcatcagtcataacatcactaggagcaatagtcagctgctatgggaaaacaaaatgcacagcttccaacaaaaacaaaggaatcataaaaacattctcaaatggttgtgactacgtatccaacaaaggagtagatacagtatctgtaggcaacacattatactatgtaaataaacaagaaggacaaagcctatacgtcaaaggagaacccatcataaatttctatgacccattagttttcccatctgacgaatttgacgcttccatctcccaagtaaatgaaaaaatcaaccaaagcctcgcattcattcgcaaatctgacgaattactccacaacgtaaacgtaggaaaatccacaacaaacattatgatcaccaccataataatcgtaataatagtcatattactactcctcatagcagtaggactattcctatactgtaaagctagataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18367 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut6 (opt11)
  source 1..1762: mol_type = other RNA
gggagaaagcttaccatggaattaccaatcctcaaaactaacgccatcaccaccatcctcgctgccgtcaccctctgcttcgcctccagccaaaacatcacagaagagttctaccaaagcacatgctccgctgtctccaaaggctaccttggcgccctccgcaccggctggtacacctcagtaattaccattgaactaagcaacatcaaagaaaataaatgcaacggcaccgacgccaaagttaaactcataaaacaggaactcgacaaatacaaaaacgccgtaacagacctccaaatgctcatgtgctccacccccgccgccggctcaggctccgccatcgcaagcggaatagcagtttgcaaagtcctccacctagaaggcgaggtcaacaagattaaaaacgcacttctctcaaccaacaaggccgtcgtatcactctcaaacggcgtctccgtcctcaccttcaaagttctggacctcaaaaactacatcgataaacaactactcccaatacttaacaaacaatcatgctccatcccaaaccccgaaaccgtcatggagttccaacagaaaaacaaccgcctactggaaatcacacgcgagttcagcgtaaacgctggcgtcactacacccgtctccacctacatgctcaccaattctgaactcctatcactcataaacgacatgcccattaccaacgaccaaaagaaactaatgtcaaacaacgtccaaatcgtaagacaacaatcgtattccatcatgtgcataattaaagaagaagttctcgcctacgtggtccaactacccctctacggagtcatagacactccttgttggaaactccacacctctcccctctgcactaccaacacaaaagaaggctccaacatctgcctcacccgaaccgacagaggctggtactgcgacaacgccggctccgtctccttcttcccccaagccgaaacctgcaaagtctgctccaaccgcgttttctgcgacaccatgaactccctcacactcccctccgaagtcaacctatgtaacatagacatattcaacccaaaatacgactgcaaaatcatgacatccaaaaccgacgtgtcttcctcggtcatcacctccctcggcgccatcgtctcatgctacggcaaaactaaatgcaccgcatccaacaaaaacaaaggcataatcaaaacattctccaacggctgcgactacgtttctaacaaaggcgtcgataccgtctccgtcggaaacaccctctactacgtaaacaagcaagaaggccagtccctatacgtaaaaggagaaccaattatcaacttctacgaccccctagtcttcccctccgacgagttcgacgcctccatatcccaagtcaacgagaaaatcaaccaatccctagccttcatccgcaaatcagacgaactcctccacaacgtcaacgtcggaaaatccacaactaacatcatgatcaccaccatcattatcgtcatcatagttatactcctcctcctcatagccgtcggcctcttcctatactgcaaagctcgctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18368 - protein, 535 aa, synthetic construct
  REGION 1..535: note = derived and/or modified protein sequence (artificial) from HRSV(Memphis-37)__AIY60640.1__F_DSCav1_mut7
MELPILKTNAITTILAAVTLCFASSQNITEEFYQSTCSAVSKGYLSALRTGWYTSVITIELSNIKENKCNGTDAKVKLIKQELDKYKNAVTELQMLMCSTPAAGSGSAIASGIAVCKVLHLEGEVNKIKNALLSTNKAVVSLSNGVSVLTFKVLDLKNYIDKQLLPILNKQSCSISNIETVMEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVCSNRVFCDTMNSLTLPSEVNLCNIDIFNPKYDCKIMTSKTDVSSSVITSLGAIVSCYGKTKCTASNKNKGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 18369 - RNA, 1608 nt, synthetic construct
  misc_feature 1..1608: note = derived and/or modified CDS sequence (opt1) from HRSV(Memphis-37)__AIY60640.1__F_DSCav1_mut7
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactga

SEQ ID NO: 18370 - RNA, 1608 nt, synthetic construct
  misc_feature 1..1608: note = derived and/or modified CDS sequence (opt1) from HRSV(Memphis-37)__AIY60640.1__F_DSCav1_mut7
  source 1..1608: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactga

SEQ ID NO: 18371 - RNA, 1608 nt, synthetic construct
  misc_feature 1..1608: note = derived and/or modified CDS sequence (opt2) from HRSV(Memphis-37)__AIY60640.1__F_DSCav1_mut7
  source 1..1608: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactga

SEQ ID NO: 18372 - RNA, 1608 nt, synthetic construct
  misc_feature 1..1608: note = derived and/or modified CDS sequence (opt3) from HRSV(Memphis-37)__AIY60640.1__F_DSCav1_mut7
  source 1..1608: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattga

SEQ ID NO: 18373 - RNA, 1608 nt, synthetic construct
  misc_feature 1..1608: note = derived and/or modified CDS sequence (opt4) from HRSV(Memphis-37)__AIY60640.1__F_DSCav1_mut7
  source 1..1608: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactga

SEQ ID NO: 18374 - RNA, 1608 nt, synthetic construct
  misc_feature 1..1608: note = derived and/or modified CDS sequence (opt5) from HRSV(Memphis-37)__AIY60640.1__F_DSCav1_mut7
  source 1..1608: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattga

SEQ ID NO: 18375 - RNA, 1608 nt, synthetic construct
  misc_feature 1..1608: note = derived and/or modified CDS sequence (opt6) from HRSV(Memphis-37)__AIY60640.1__F_DSCav1_mut7
  source 1..1608: mol_type = other RNA
atggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactga

SEQ ID NO: 18376 - RNA, 1608 nt, synthetic construct
  misc_feature 1..1608: note = derived and/or modified CDS sequence (opt11) from HRSV(Memphis-37)__AIY60640.1__F_DSCav1_mut7
  source 1..1608: mol_type = other RNA
atggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaa

SEQ ID NO: 18377 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut7 (opt1)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18378 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut7 (opt1)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18379 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut7 (opt2)
  source 1..1884: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18380 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut7 (opt3)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18381 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut7 (opt4)
  source 1..1884: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18382 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut7 (opt5)
  source 1..1884: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18383 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut7 (opt6)
  source 1..1884: mol_type = other RNA
gggagagtcccgcagtcggcgtccagcggctctgcttgttcgtgtgtgtgtcgttgcaggccttattcaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18384 - RNA, 1884 nt, synthetic construct
  misc_feature 1..1884: note = mRNA product Design a-1 comprising derived and/or modified sequence from HRSV(Memphis-37)__AIY60640.1__F_DSCav1_mut7 (opt11)
  source 1..1884: mol_type = other RNA
gggagagtcccgcagtcggcgtccagcggctctgcttgttcgtgtgtgtgtcgttgcaggccttattcaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18385 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut7 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18386 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut7 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18387 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut7 (opt2)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18388 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut7 (opt3)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18389 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut7 (opt4)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18390 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut7 (opt5)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18391 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut7 (opt6)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18392 - RNA, 1903 nt, synthetic construct
  misc_feature 1..1903: note = mRNA product Design a-2 comprising derived and/or modified sequence from HRSV(Memphis-37)__AIY60640.1__F_DSCav1_mut7 (opt11)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18393 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut7 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18394 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut7 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18395 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut7 (opt2)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18396 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut7 (opt3)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18397 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut7 (opt4)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18398 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut7 (opt5)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18399 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut7 (opt6)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18400 - RNA, 1981 nt, synthetic construct
  misc_feature 1..1981: note = mRNA product Design a-3 comprising derived and/or modified sequence from HRSV(Memphis-37)__AIY60640.1__F_DSCav1_mut7 (opt11)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18401 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut7 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18402 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut7 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18403 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut7 (opt2)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18404 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut7 (opt3)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18405 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut7 (opt4)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18406 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut7 (opt5)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18407 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut7 (opt6)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18408 - RNA, 1930 nt, synthetic construct
  misc_feature 1..1930: note = mRNA product Design a-4 comprising derived and/or modified sequence from HRSV(Memphis-37)__AIY60640.1__F_DSCav1_mut7 (opt11)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18409 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut7 (opt1)
  source 1..1876: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18410 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut7 (opt1)
  source 1..1876: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18411 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut7 (opt2)
  source 1..1876: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18412 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut7 (opt3)
  source 1..1876: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18413 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut7 (opt4)
  source 1..1876: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18414 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut7 (opt5)
  source 1..1876: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18415 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut7 (opt6)
  source 1..1876: mol_type = other RNA
gggagactttcccattctgtagcagaatttggtgttgcctgtggtcttggtcccgcggagaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18416 - RNA, 1876 nt, synthetic construct
  misc_feature 1..1876: note = mRNA product Design a-5 comprising derived and/or modified sequence from HRSV(Memphis-37)__AIY60640.1__F_DSCav1_mut7 (opt11)
  source 1..1876: mol_type = other RNA
gggagactttcccattctgtagcagaatttggtgttgcctgtggtcttggtcccgcggagaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18417 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut7 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18418 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut7 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18419 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut7 (opt2)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18420 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut7 (opt3)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18421 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut7 (opt4)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18422 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut7 (opt5)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18423 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut7 (opt6)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18424 - RNA, 2057 nt, synthetic construct
  misc_feature 1..2057: note = mRNA product Design b-1 comprising derived and/or modified sequence from HRSV(Memphis-37)__AIY60640.1__F_DSCav1_mut7 (opt11)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18425 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut7 (opt1)
  source 1..1877: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18426 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut7 (opt1)
  source 1..1877: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18427 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut7 (opt2)
  source 1..1877: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18428 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut7 (opt3)
  source 1..1877: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18429 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut7 (opt4)
  source 1..1877: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18430 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut7 (opt5)
  source 1..1877: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18431 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut7 (opt6)
  source 1..1877: mol_type = other RNA
gggagagcctctgctggagtccggggagtggcgttggctgctagagcgaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18432 - RNA, 1877 nt, synthetic construct
  misc_feature 1..1877: note = mRNA product Design b-2 comprising derived and/or modified sequence from HRSV(Memphis-37)__AIY60640.1__F_DSCav1_mut7 (opt11)
  source 1..1877: mol_type = other RNA
gggagagcctctgctggagtccggggagtggcgttggctgctagagcgaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18433 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut7 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18434 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut7 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18435 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut7 (opt2)
  source 1..1897: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18436 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut7 (opt3)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18437 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut7 (opt4)
  source 1..1897: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18438 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut7 (opt5)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18439 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut7 (opt6)
  source 1..1897: mol_type = other RNA
gggagagtcccgcagtcggcgtccagcggctctgcttgttcgtgtgtgtgtcgttgcaggccttattcaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18440 - RNA, 1897 nt, synthetic construct
  misc_feature 1..1897: note = mRNA product Design b-3 comprising derived and/or modified sequence from HRSV(Memphis-37)__AIY60640.1__F_DSCav1_mut7 (opt11)
  source 1..1897: mol_type = other RNA
gggagagtcccgcagtcggcgtccagcggctctgcttgttcgtgtgtgtgtcgttgcaggccttattcaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18441 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut7 (opt1)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18442 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut7 (opt1)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18443 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut7 (opt2)
  source 1..1948: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18444 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut7 (opt3)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18445 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut7 (opt4)
  source 1..1948: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18446 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut7 (opt5)
  source 1..1948: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18447 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut7 (opt6)
  source 1..1948: mol_type = other RNA
gggagagtcccgcagtcggcgtccagcggctctgcttgttcgtgtgtgtgtcgttgcaggccttattcaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18448 - RNA, 1948 nt, synthetic construct
  misc_feature 1..1948: note = mRNA product Design b-4 comprising derived and/or modified sequence from HRSV(Memphis-37)__AIY60640.1__F_DSCav1_mut7 (opt11)
  source 1..1948: mol_type = other RNA
gggagagtcccgcagtcggcgtccagcggctctgcttgttcgtgtgtgtgtcgttgcaggccttattcaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18449 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut7 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18450 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut7 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18451 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut7 (opt2)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18452 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut7 (opt3)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18453 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut7 (opt4)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18454 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut7 (opt5)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18455 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut7 (opt6)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18456 - RNA, 2010 nt, synthetic construct
  misc_feature 1..2010: note = mRNA product Design b-5 comprising derived and/or modified sequence from HRSV(Memphis-37)__AIY60640.1__F_DSCav1_mut7 (opt11)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18457 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut7 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18458 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut7 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18459 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut7 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18460 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut7 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18461 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut7 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18462 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut7 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18463 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut7 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18464 - RNA, 1916 nt, synthetic construct
  misc_feature 1..1916: note = mRNA product Design c-1 comprising derived and/or modified sequence from HRSV(Memphis-37)__AIY60640.1__F_DSCav1_mut7 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18465 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut7 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18466 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut7 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18467 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut7 (opt2)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18468 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut7 (opt3)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18469 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut7 (opt4)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18470 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut7 (opt5)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18471 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut7 (opt6)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18472 - RNA, 2006 nt, synthetic construct
  misc_feature 1..2006: note = mRNA product Design c-2 comprising derived and/or modified sequence from HRSV(Memphis-37)__AIY60640.1__F_DSCav1_mut7 (opt11)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18473 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut7 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18474 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut7 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18475 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut7 (opt2)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18476 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut7 (opt3)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18477 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut7 (opt4)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18478 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut7 (opt5)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18479 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut7 (opt6)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18480 - RNA, 1983 nt, synthetic construct
  misc_feature 1..1983: note = mRNA product Design c-3 comprising derived and/or modified sequence from HRSV(Memphis-37)__AIY60640.1__F_DSCav1_mut7 (opt11)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18481 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut7 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18482 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut7 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18483 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut7 (opt2)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18484 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut7 (opt3)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18485 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut7 (opt4)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18486 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut7 (opt5)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18487 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut7 (opt6)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18488 - RNA, 1979 nt, synthetic construct
  misc_feature 1..1979: note = mRNA product Design c-4 comprising derived and/or modified sequence from HRSV(Memphis-37)__AIY60640.1__F_DSCav1_mut7 (opt11)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18489 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut7 (opt1)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18490 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut7 (opt1)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18491 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut7 (opt2)
  source 1..1897: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18492 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut7 (opt3)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18493 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut7 (opt4)
  source 1..1897: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18494 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut7 (opt5)
  source 1..1897: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18495 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut7 (opt6)
  source 1..1897: mol_type = other RNA
gggagagcggctcggccattttgtcccagtcagtccggaggctgcggctgcagaagtaccgcctgcggagtaactgcaaagaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18496 - RNA, 1897 nt, synthetic construct
  misc_feature 1..1897: note = mRNA product Design c-5 comprising derived and/or modified sequence from HRSV(Memphis-37)__AIY60640.1__F_DSCav1_mut7 (opt11)
  source 1..1897: mol_type = other RNA
gggagagcggctcggccattttgtcccagtcagtccggaggctgcggctgcagaagtaccgcctgcggagtaactgcaaagaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18497 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut7 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18498 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut7 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18499 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut7 (opt2)
  source 1..1906: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18500 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut7 (opt3)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18501 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut7 (opt4)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18502 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut7 (opt5)
  source 1..1906: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18503 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut7 (opt6)
  source 1..1906: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18504 - RNA, 1906 nt, synthetic construct
  misc_feature 1..1906: note = mRNA product Design d-1 comprising derived and/or modified sequence from HRSV(Memphis-37)__AIY60640.1__F_DSCav1_mut7 (opt11)
  source 1..1906: mol_type = other RNA
gggagacccgtgacccggaagttgtacggctacgcgactttccctcccacaaaccctcgcgcccttcctttcctacttgggcccggcagaaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18505 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut7 (opt1)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18506 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut7 (opt1)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18507 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut7 (opt2)
  source 1..1961: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18508 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut7 (opt3)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18509 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut7 (opt4)
  source 1..1961: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18510 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut7 (opt5)
  source 1..1961: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18511 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut7 (opt6)
  source 1..1961: mol_type = other RNA
gggagagcggctcggccattttgtcccagtcagtccggaggctgcggctgcagaagtaccgcctgcggagtaactgcaaagaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18512 - RNA, 1961 nt, synthetic construct
  misc_feature 1..1961: note = mRNA product Design d-2 comprising derived and/or modified sequence from HRSV(Memphis-37)__AIY60640.1__F_DSCav1_mut7 (opt11)
  source 1..1961: mol_type = other RNA
gggagagcggctcggccattttgtcccagtcagtccggaggctgcggctgcagaagtaccgcctgcggagtaactgcaaagaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18513 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut7 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18514 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut7 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18515 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut7 (opt2)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18516 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut7 (opt3)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18517 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut7 (opt4)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18518 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut7 (opt5)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18519 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut7 (opt6)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18520 - RNA, 2277 nt, synthetic construct
  misc_feature 1..2277: note = mRNA product Design d-3 comprising derived and/or modified sequence from HRSV(Memphis-37)__AIY60640.1__F_DSCav1_mut7 (opt11)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18521 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut7 (opt1)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18522 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut7 (opt1)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18523 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut7 (opt2)
  source 1..1960: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18524 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut7 (opt3)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18525 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut7 (opt4)
  source 1..1960: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18526 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut7 (opt5)
  source 1..1960: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18527 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut7 (opt6)
  source 1..1960: mol_type = other RNA
gggagagtcccgcagtcggcgtccagcggctctgcttgttcgtgtgtgtgtcgttgcaggccttattcaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18528 - RNA, 1960 nt, synthetic construct
  misc_feature 1..1960: note = mRNA product Design d-4 comprising derived and/or modified sequence from HRSV(Memphis-37)__AIY60640.1__F_DSCav1_mut7 (opt11)
  source 1..1960: mol_type = other RNA
gggagagtcccgcagtcggcgtccagcggctctgcttgttcgtgtgtgtgtcgttgcaggccttattcaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18529 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut7 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18530 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut7 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18531 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut7 (opt2)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18532 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut7 (opt3)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18533 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut7 (opt4)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18534 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut7 (opt5)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18535 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut7 (opt6)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18536 - RNA, 2057 nt, synthetic construct
  misc_feature 1..2057: note = mRNA product Design d-5 comprising derived and/or modified sequence from HRSV(Memphis-37)__AIY60640.1__F_DSCav1_mut7 (opt11)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18537 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut7 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18538 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut7 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18539 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut7 (opt2)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18540 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut7 (opt3)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18541 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut7 (opt4)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18542 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut7 (opt5)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18543 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut7 (opt6)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18544 - RNA, 1937 nt, synthetic construct
  misc_feature 1..1937: note = mRNA product Design e-1 comprising derived and/or modified sequence from HRSV(Memphis-37)__AIY60640.1__F_DSCav1_mut7 (opt11)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18545 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut7 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18546 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut7 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18547 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut7 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18548 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut7 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18549 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut7 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18550 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut7 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18551 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut7 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18552 - RNA, 1919 nt, synthetic construct
  misc_feature 1..1919: note = mRNA product Design e-2 comprising derived and/or modified sequence from HRSV(Memphis-37)__AIY60640.1__F_DSCav1_mut7 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18553 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut7 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18554 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut7 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18555 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut7 (opt2)
  source 1..1889: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18556 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut7 (opt3)
  source 1..1889: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18557 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut7 (opt4)
  source 1..1889: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18558 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut7 (opt5)
  source 1..1889: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18559 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut7 (opt6)
  source 1..1889: mol_type = other RNA
gggagactttcccattctgtagcagaatttggtgttgcctgtggtcttggtcccgcggagaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18560 - RNA, 1889 nt, synthetic construct
  misc_feature 1..1889: note = mRNA product Design e-3 comprising derived and/or modified sequence from HRSV(Memphis-37)__AIY60640.1__F_DSCav1_mut7 (opt11)
  source 1..1889: mol_type = other RNA
gggagactttcccattctgtagcagaatttggtgttgcctgtggtcttggtcccgcggagaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18561 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut7 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18562 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut7 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18563 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut7 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18564 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut7 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18565 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut7 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18566 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut7 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18567 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut7 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18568 - RNA, 1943 nt, synthetic construct
  misc_feature 1..1943: note = mRNA product Design e-4 comprising derived and/or modified sequence from HRSV(Memphis-37)__AIY60640.1__F_DSCav1_mut7 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18569 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut7 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18570 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut7 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18571 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut7 (opt2)
  source 1..1910: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18572 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut7 (opt3)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18573 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut7 (opt4)
  source 1..1910: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18574 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut7 (opt5)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18575 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut7 (opt6)
  source 1..1910: mol_type = other RNA
gggagagcggctcggccattttgtcccagtcagtccggaggctgcggctgcagaagtaccgcctgcggagtaactgcaaagaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18576 - RNA, 1910 nt, synthetic construct
  misc_feature 1..1910: note = mRNA product Design e-5 comprising derived and/or modified sequence from HRSV(Memphis-37)__AIY60640.1__F_DSCav1_mut7 (opt11)
  source 1..1910: mol_type = other RNA
gggagagcggctcggccattttgtcccagtcagtccggaggctgcggctgcagaagtaccgcctgcggagtaactgcaaagaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18577 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut7 (opt1)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18578 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut7 (opt1)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18579 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut7 (opt2)
  source 1..1977: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18580 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut7 (opt3)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18581 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut7 (opt4)
  source 1..1977: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18582 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut7 (opt5)
  source 1..1977: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18583 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut7 (opt6)
  source 1..1977: mol_type = other RNA
gggagagcggctcggccattttgtcccagtcagtccggaggctgcggctgcagaagtaccgcctgcggagtaactgcaaagaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18584 - RNA, 1977 nt, synthetic construct
  misc_feature 1..1977: note = mRNA product Design e-6 comprising derived and/or modified sequence from HRSV(Memphis-37)__AIY60640.1__F_DSCav1_mut7 (opt11)
  source 1..1977: mol_type = other RNA
gggagagcggctcggccattttgtcccagtcagtccggaggctgcggctgcagaagtaccgcctgcggagtaactgcaaagaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18585 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut7 (opt1)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18586 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut7 (opt1)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18587 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut7 (opt2)
  source 1..2193: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18588 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut7 (opt3)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18589 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut7 (opt4)
  source 1..2193: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18590 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut7 (opt5)
  source 1..2193: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18591 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut7 (opt6)
  source 1..2193: mol_type = other RNA
gggagagcggctcggccattttgtcccagtcagtccggaggctgcggctgcagaagtaccgcctgcggagtaactgcaaagaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18592 - RNA, 2193 nt, synthetic construct
  misc_feature 1..2193: note = mRNA product Design f-1 comprising derived and/or modified sequence from HRSV(Memphis-37)__AIY60640.1__F_DSCav1_mut7 (opt11)
  source 1..2193: mol_type = other RNA
gggagagcggctcggccattttgtcccagtcagtccggaggctgcggctgcagaagtaccgcctgcggagtaactgcaaagaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18593 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut7 (opt1)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18594 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut7 (opt1)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18595 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut7 (opt2)
  source 1..1973: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18596 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut7 (opt3)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18597 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut7 (opt4)
  source 1..1973: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18598 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut7 (opt5)
  source 1..1973: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18599 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut7 (opt6)
  source 1..1973: mol_type = other RNA
gggagagcggctcggccattttgtcccagtcagtccggaggctgcggctgcagaagtaccgcctgcggagtaactgcaaagaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18600 - RNA, 1973 nt, synthetic construct
  misc_feature 1..1973: note = mRNA product Design f-2 comprising derived and/or modified sequence from HRSV(Memphis-37)__AIY60640.1__F_DSCav1_mut7 (opt11)
  source 1..1973: mol_type = other RNA
gggagagcggctcggccattttgtcccagtcagtccggaggctgcggctgcagaagtaccgcctgcggagtaactgcaaagaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18601 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut7 (opt1)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18602 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut7 (opt1)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18603 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut7 (opt2)
  source 1..1964: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18604 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut7 (opt3)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18605 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut7 (opt4)
  source 1..1964: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18606 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut7 (opt5)
  source 1..1964: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18607 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut7 (opt6)
  source 1..1964: mol_type = other RNA
gggagagtcccgcagtcggcgtccagcggctctgcttgttcgtgtgtgtgtcgttgcaggccttattcaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18608 - RNA, 1964 nt, synthetic construct
  misc_feature 1..1964: note = mRNA product Design f-3 comprising derived and/or modified sequence from HRSV(Memphis-37)__AIY60640.1__F_DSCav1_mut7 (opt11)
  source 1..1964: mol_type = other RNA
gggagagtcccgcagtcggcgtccagcggctctgcttgttcgtgtgtgtgtcgttgcaggccttattcaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18609 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut7 (opt1)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18610 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut7 (opt1)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18611 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut7 (opt2)
  source 1..2180: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18612 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut7 (opt3)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18613 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut7 (opt4)
  source 1..2180: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18614 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut7 (opt5)
  source 1..2180: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18615 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut7 (opt6)
  source 1..2180: mol_type = other RNA
gggagagtcccgcagtcggcgtccagcggctctgcttgttcgtgtgtgtgtcgttgcaggccttattcaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18616 - RNA, 2180 nt, synthetic construct
  misc_feature 1..2180: note = mRNA product Design f-4 comprising derived and/or modified sequence from HRSV(Memphis-37)__AIY60640.1__F_DSCav1_mut7 (opt11)
  source 1..2180: mol_type = other RNA
gggagagtcccgcagtcggcgtccagcggctctgcttgttcgtgtgtgtgtcgttgcaggccttattcaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18617 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut7 (opt1)
  source 1..1956: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18618 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut7 (opt1)
  source 1..1956: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18619 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut7 (opt2)
  source 1..1956: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18620 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut7 (opt3)
  source 1..1956: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18621 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut7 (opt4)
  source 1..1956: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18622 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut7 (opt5)
  source 1..1956: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18623 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut7 (opt6)
  source 1..1956: mol_type = other RNA
gggagactttcccattctgtagcagaatttggtgttgcctgtggtcttggtcccgcggagaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18624 - RNA, 1956 nt, synthetic construct
  misc_feature 1..1956: note = mRNA product Design f-5 comprising derived and/or modified sequence from HRSV(Memphis-37)__AIY60640.1__F_DSCav1_mut7 (opt11)
  source 1..1956: mol_type = other RNA
gggagactttcccattctgtagcagaatttggtgttgcctgtggtcttggtcccgcggagaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18625 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut7 (opt1)
  source 1..1952: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18626 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut7 (opt1)
  source 1..1952: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18627 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut7 (opt2)
  source 1..1952: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18628 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut7 (opt3)
  source 1..1952: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18629 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut7 (opt4)
  source 1..1952: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18630 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut7 (opt5)
  source 1..1952: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18631 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut7 (opt6)
  source 1..1952: mol_type = other RNA
gggagactttcccattctgtagcagaatttggtgttgcctgtggtcttggtcccgcggagaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18632 - RNA, 1952 nt, synthetic construct
  misc_feature 1..1952: note = mRNA product Design g-1 comprising derived and/or modified sequence from HRSV(Memphis-37)__AIY60640.1__F_DSCav1_mut7 (opt11)
  source 1..1952: mol_type = other RNA
gggagactttcccattctgtagcagaatttggtgttgcctgtggtcttggtcccgcggagaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18633 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut7 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18634 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut7 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18635 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut7 (opt2)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18636 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut7 (opt3)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18637 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut7 (opt4)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18638 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut7 (opt5)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18639 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut7 (opt6)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18640 - RNA, 1967 nt, synthetic construct
  misc_feature 1..1967: note = mRNA product Design g-2 comprising derived and/or modified sequence from HRSV(Memphis-37)__AIY60640.1__F_DSCav1_mut7 (opt11)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18641 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut7 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18642 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut7 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18643 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut7 (opt2)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18644 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut7 (opt3)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18645 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut7 (opt4)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18646 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut7 (opt5)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18647 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut7 (opt6)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18648 - RNA, 2199 nt, synthetic construct
  misc_feature 1..2199: note = mRNA product Design g-3 comprising derived and/or modified sequence from HRSV(Memphis-37)__AIY60640.1__F_DSCav1_mut7 (opt11)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18649 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut7 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18650 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut7 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18651 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut7 (opt2)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18652 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut7 (opt3)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18653 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut7 (opt4)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18654 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut7 (opt5)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18655 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut7 (opt6)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18656 - RNA, 1994 nt, synthetic construct
  misc_feature 1..1994: note = mRNA product Design g-4 comprising derived and/or modified sequence from HRSV(Memphis-37)__AIY60640.1__F_DSCav1_mut7 (opt11)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18657 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut7 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18658 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut7 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18659 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut7 (opt2)
  source 1..1970: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18660 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut7 (opt3)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18661 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut7 (opt4)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18662 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut7 (opt5)
  source 1..1970: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18663 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut7 (opt6)
  source 1..1970: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18664 - RNA, 1970 nt, synthetic construct
  misc_feature 1..1970: note = mRNA product Design g-5 comprising derived and/or modified sequence from HRSV(Memphis-37)__AIY60640.1__F_DSCav1_mut7 (opt11)
  source 1..1970: mol_type = other RNA
gggagacccgtgacccggaagttgtacggctacgcgactttccctcccacaaaccctcgcgcccttcctttcctacttgggcccggcagaaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18665 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut7 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18666 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut7 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18667 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut7 (opt2)
  source 1..1986: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18668 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut7 (opt3)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18669 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut7 (opt4)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18670 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut7 (opt5)
  source 1..1986: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18671 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut7 (opt6)
  source 1..1986: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18672 - RNA, 1986 nt, synthetic construct
  misc_feature 1..1986: note = mRNA product Design h-1 comprising derived and/or modified sequence from HRSV(Memphis-37)__AIY60640.1__F_DSCav1_mut7 (opt11)
  source 1..1986: mol_type = other RNA
gggagacccgtgacccggaagttgtacggctacgcgactttccctcccacaaaccctcgcgcccttcctttcctacttgggcccggcagaaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18673 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut7 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18674 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut7 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18675 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut7 (opt2)
  source 1..2202: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18676 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut7 (opt3)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18677 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut7 (opt4)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18678 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut7 (opt5)
  source 1..2202: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18679 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut7 (opt6)
  source 1..2202: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18680 - RNA, 2202 nt, synthetic construct
  misc_feature 1..2202: note = mRNA product Design h-2 comprising derived and/or modified sequence from HRSV(Memphis-37)__AIY60640.1__F_DSCav1_mut7 (opt11)
  source 1..2202: mol_type = other RNA
gggagacccgtgacccggaagttgtacggctacgcgactttccctcccacaaaccctcgcgcccttcctttcctacttgggcccggcagaaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18681 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut7 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18682 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut7 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18683 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut7 (opt2)
  source 1..1982: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18684 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut7 (opt3)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18685 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut7 (opt4)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18686 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut7 (opt5)
  source 1..1982: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18687 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut7 (opt6)
  source 1..1982: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18688 - RNA, 1982 nt, synthetic construct
  misc_feature 1..1982: note = mRNA product Design h-3 comprising derived and/or modified sequence from HRSV(Memphis-37)__AIY60640.1__F_DSCav1_mut7 (opt11)
  source 1..1982: mol_type = other RNA
gggagacccgtgacccggaagttgtacggctacgcgactttccctcccacaaaccctcgcgcccttcctttcctacttgggcccggcagaaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18689 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut7 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18690 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut7 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18691 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut7 (opt2)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18692 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut7 (opt3)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18693 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut7 (opt4)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18694 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut7 (opt5)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18695 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut7 (opt6)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18696 - RNA, 2045 nt, synthetic construct
  misc_feature 1..2045: note = mRNA product Design h-4 comprising derived and/or modified sequence from HRSV(Memphis-37)__AIY60640.1__F_DSCav1_mut7 (opt11)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18697 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut7 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18698 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut7 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18699 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut7 (opt2)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18700 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut7 (opt3)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18701 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut7 (opt4)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18702 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut7 (opt5)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18703 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut7 (opt6)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18704 - RNA, 2061 nt, synthetic construct
  misc_feature 1..2061: note = mRNA product Design h-5 comprising derived and/or modified sequence from HRSV(Memphis-37)__AIY60640.1__F_DSCav1_mut7 (opt11)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18705 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut7 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18706 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut7 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18707 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut7 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18708 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut7 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18709 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut7 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18710 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut7 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18711 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut7 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18712 - RNA, 1994 nt, synthetic construct
  misc_feature 1..1994: note = mRNA product Design i-1 comprising derived and/or modified sequence from HRSV(Memphis-37)__AIY60640.1__F_DSCav1_mut7 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18713 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut7 (opt1)
  source 1..1994: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18714 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut7 (opt1)
  source 1..1994: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18715 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut7 (opt2)
  source 1..1994: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18716 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut7 (opt3)
  source 1..1994: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18717 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut7 (opt4)
  source 1..1994: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18718 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut7 (opt5)
  source 1..1994: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18719 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut7 (opt6)
  source 1..1994: mol_type = other RNA
gggagaggcgctgcctacggaggtggcagccatctccttctcggcatcaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18720 - RNA, 1994 nt, synthetic construct
  misc_feature 1..1994: note = mRNA product Design i-2 comprising derived and/or modified sequence from HRSV(Memphis-37)__AIY60640.1__F_DSCav1_mut7 (opt11)
  source 1..1994: mol_type = other RNA
gggagaggcgctgcctacggaggtggcagccatctccttctcggcatcaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18721 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut7 (opt1)
  source 1..1990: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18722 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut7 (opt1)
  source 1..1990: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18723 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut7 (opt2)
  source 1..1990: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18724 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut7 (opt3)
  source 1..1990: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18725 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut7 (opt4)
  source 1..1990: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18726 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut7 (opt5)
  source 1..1990: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18727 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut7 (opt6)
  source 1..1990: mol_type = other RNA
ggggcgctgcctacggaggtggcagccatctccttctcggcatcaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18728 - RNA, 1990 nt, synthetic construct
  misc_feature 1..1990: note = mRNA product Design i-2 comprising derived and/or modified sequence from HRSV(Memphis-37)__AIY60640.1__F_DSCav1_mut7 (opt11)
  source 1..1990: mol_type = other RNA
ggggcgctgcctacggaggtggcagccatctccttctcggcatcaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18729 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut7 (opt1)
  source 1..1825: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18730 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut7 (opt1)
  source 1..1825: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgcagcacgcccgtgaccctgtccaaggaccagctgagcgggatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18731 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut7 (opt2)
  source 1..1825: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18732 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut7 (opt3)
  source 1..1825: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggagtacccccgtcacattgtctaaagaccagctgagcggcatcaataacattgctttctccaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18733 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut7 (opt4)
  source 1..1825: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18734 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut7 (opt5)
  source 1..1825: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctctacccccgtgacactgtccaaagaccagcttagcggcatcaataacatcgcgttctctaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18735 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut7 (opt6)
  source 1..1825: mol_type = other RNA
gggagaaagcttaccatggaactaccaatactcaaaacaaatgctataaccacaatactcgcagcagtaacattatgtttcgcatcatcccaaaacataacagaagaattttatcaatcaacctgttcagcagtatccaaaggatacctaagtgcattaagaaccggatggtacacatcagtaataaccatagaactttcaaacataaaagaaaacaaatgtaacggcacagacgcaaaagtcaaactcatcaaacaggaacttgacaaatataaaaacgcagtaaccgaactacaaatgctaatgtgctcaacaccagcagcaggatcaggatcagcaattgcatctggaatagctgtatgcaaagtcctacacctagaaggagaagtaaacaaaatcaaaaacgcattactctccacaaacaaagcagtagtatcactatcaaacggagtttcagtactaaccttcaaagtattagacctaaaaaactacatagacaaacaactactacctatactaaacaaacaatcctgttcaataagcaacattgaaactgtaatggaatttcaacaaaaaaacaaccgcctattagaaataaccagagaattttccgtaaatgcaggagtaaccacaccagtctctacatacatgttaaccaactcagaactattatcactcataaatgacatgcctataacaaacgaccaaaaaaaactaatgtcaaacaacgtacaaatagtaagacaacaatcatattccataatgtgcataataaaagaagaagtacttgcatacgtggttcaactacccctatatggagttatagacacaccatgctggaaactccacacttccccactttgcacaactaacacaaaagaaggatcaaatatatgcctaaccagaacagaccgtggatggtactgcgacaacgctggatcagtctccttctttccacaagcagaaacctgcaaagtctgctcaaatagagtcttctgtgacacaatgaactcactcaccctaccctcagaagtaaacctatgtaatatagatatatttaatccaaaatacgactgcaaaattatgacaagtaaaacagacgtaagctcatcagtcataaccagcctaggagcaatagtatcctgttacggcaaaacaaaatgcacagcttcaaacaaaaacaaaggcataataaaaacattctcaaacggatgtgactatgtatcaaataaaggagttgacacagtatcagttggaaacacactatactatgtaaacaaacaagaaggaaaatcactatacgttaaaggcgaacccataatcaatttctacgaccccctagtcttcccatccgatgaatttgacgcatcaatatcccaagtaaatgaaaaaatcaaccaatccctagcatttatacgaaaatccgacgaactactccataatgtcaacgtcggtaaatcaacgacaaacatcatgatcacaacaataataatagtaataattgtaatattactcttactcatagcagtaggcctatttctatattgcaaagccagatcaacaccagtaaccttatccaaagaccaactatctggaataaacaacatagcattttccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18736 - RNA, 1825 nt, synthetic construct
  misc_feature 1..1825: note = mRNA product Design i-3 comprising derived and/or modified sequence from HRSV(Memphis-37)__AIY60640.1__F_DSCav1_mut7 (opt11)
  source 1..1825: mol_type = other RNA
gggagaaagcttaccatggaactccccatacttaaaacaaacgccataacaactatactcgcagccgtcaccctctgtttcgcatcctctcaaaacatcaccgaagagttctatcaatcaacctgctccgccgtctcaaaaggctacctctccgccctacgcacaggctggtacaccagcgtcattaccatagaactctcgaacatcaaagaaaacaaatgcaacggcaccgacgcaaaagtgaaactcatcaaacaagaactcgacaaatacaaaaacgccgtcaccgaacttcagatgctcatgtgctccacccctgccgccggcagcggctccgccatagcctccggcatcgcagtctgcaaagtcctccacctcgaaggagaagtaaacaaaatcaaaaatgctctcctctccacaaacaaagccgtcgtctcactctccaatggagtctccgtcctcaccttcaaagtcctcgacctcaaaaactacatagacaaacaactactccccatcctcaacaagcaatcctgctctatctccaacatagaaaccgttatggagttccaacagaaaaataaccgcctgctagaaataacccgagagttctccgtcaacgcaggcgtcactacccccgtcagcacatacatgctaacaaactccgaactgctctcccttatcaacgacatgcccatcacaaacgatcagaaaaagctcatgtctaacaacgtacaaatcgttcggcaacaatcctactccatcatgtgcatcatcaaagaagaagtgctcgcctacgtagtccaactccccctctacggagtcatcgacacaccctgctggaaactccacacatcacccctctgcaccaccaacacaaaagaagggtccaacatctgcctcacgcgcaccgaccgaggctggtactgcgacaacgccggctccgtatccttcttcccccaagcagaaacctgcaaggtctgctccaaccgcgtattctgcgacaccatgaactcgctcaccctcccctcagaagtcaacctatgtaacatcgacatattcaatcccaaatacgactgcaagataatgacttccaaaaccgacgtaagctcctcggtcatcacctccctcggcgccatcgtctcctgctacggcaaaaccaaatgcaccgcctccaataagaataaaggcataataaagacattcagcaacggctgcgattacgtctccaacaaaggtgtcgacaccgtctcagtcggcaacactctatactacgtgaacaaacaagaaggcaaaagcctatacgttaaaggcgaaccaataatcaatttctacgaccctctagtctttccctctgacgagttcgatgccagcataagccaagtcaacgaaaagatcaaccaatcactcgccttcatccgtaaatccgacgaactgctccacaatgtcaatgtaggcaaatcaacaaccaacatcatgatcaccactattatcatcgtcatcatcgtaatcctactcctactaatcgccgtcggcctattcctctactgcaaagcccgctcgacccccgtcactctcagcaaggatcaactatccggcatcaacaacatcgccttctccaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18737 - protein, 514 aa, synthetic construct
  REGION 1..514: note = derived and/or modified protein sequence (artificial) from HRSV(Memphis-37)__AIY60640.1__F-del_DSCav1_mut7
MELPILKTNAITTILAAVTLCFASSQNITEEFYQSTCSAVSKGYLSALRTGWYTSVITIELSNIKENKCNGTDAKVKLIKQELDKYKNAVTELQMLMCSTPAAGSGSAIASGIAVCKVLHLEGEVNKIKNALLSTNKAVVSLSNGVSVLTFKVLDLKNYIDKQLLPILNKQSCSISNIETVMEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVCSNRVFCDTMNSLTLPSEVNLCNIDIFNPKYDCKIMTSKTDVSSSVITSLGAIVSCYGKTKCTASNKNKGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKAR

SEQ ID NO: 18738 - RNA, 1545 nt, synthetic construct
  misc_feature 1..1545: note = derived and/or modified CDS sequence (opt1) from HRSV(Memphis-37)__AIY60640.1__F-del_DSCav1_mut7
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctga

SEQ ID NO: 18739 - RNA, 1545 nt, synthetic construct
  misc_feature 1..1545: note = derived and/or modified CDS sequence (opt1) from HRSV(Memphis-37)__AIY60640.1__F-del_DSCav1_mut7
  source 1..1545: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctga

SEQ ID NO: 18740 - RNA, 1545 nt, synthetic construct
  misc_feature 1..1545: note = derived and/or modified CDS sequence (opt2) from HRSV(Memphis-37)__AIY60640.1__F-del_DSCav1_mut7
  source 1..1545: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctga

SEQ ID NO: 18741 - RNA, 1545 nt, synthetic construct
  misc_feature 1..1545: note = derived and/or modified CDS sequence (opt3) from HRSV(Memphis-37)__AIY60640.1__F-del_DSCav1_mut7
  source 1..1545: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtga

SEQ ID NO: 18742 - RNA, 1545 nt, synthetic construct
  misc_feature 1..1545: note = derived and/or modified CDS sequence (opt4) from HRSV(Memphis-37)__AIY60640.1__F-del_DSCav1_mut7
  source 1..1545: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatga

SEQ ID NO: 18743 - RNA, 1545 nt, synthetic construct
  misc_feature 1..1545: note = derived and/or modified CDS sequence (opt5) from HRSV(Memphis-37)__AIY60640.1__F-del_DSCav1_mut7
  source 1..1545: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctga

SEQ ID NO: 18744 - RNA, 1545 nt, synthetic construct
  misc_feature 1..1545: note = derived and/or modified CDS sequence (opt6) from HRSV(Memphis-37)__AIY60640.1__F-del_DSCav1_mut7
  source 1..1545: mol_type = other RNA
atggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataa

SEQ ID NO: 18745 - RNA, 1545 nt, synthetic construct
  misc_feature 1..1545: note = derived and/or modified CDS sequence (opt11) from HRSV(Memphis-37)__AIY60640.1__F-del_DSCav1_mut7
  source 1..1545: mol_type = other RNA
atggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaa

SEQ ID NO: 18746 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut7 (opt1)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18747 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut7 (opt1)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18748 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut7 (opt2)
  source 1..1821: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18749 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut7 (opt3)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18750 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut7 (opt4)
  source 1..1821: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18751 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut7 (opt5)
  source 1..1821: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18752 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut7 (opt6)
  source 1..1821: mol_type = other RNA
gggagagtcccgcagtcggcgtccagcggctctgcttgttcgtgtgtgtgtcgttgcaggccttattcaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18753 - RNA, 1821 nt, synthetic construct
  misc_feature 1..1821: note = mRNA product Design a-1 comprising derived and/or modified sequence from HRSV(Memphis-37)__AIY60640.1__F-del_DSCav1_mut7 (opt11)
  source 1..1821: mol_type = other RNA
gggagagtcccgcagtcggcgtccagcggctctgcttgttcgtgtgtgtgtcgttgcaggccttattcaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18754 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut7 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18755 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut7 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18756 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut7 (opt2)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18757 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut7 (opt3)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18758 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut7 (opt4)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18759 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut7 (opt5)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18760 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut7 (opt6)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18761 - RNA, 1840 nt, synthetic construct
  misc_feature 1..1840: note = mRNA product Design a-2 comprising derived and/or modified sequence from HRSV(Memphis-37)__AIY60640.1__F-del_DSCav1_mut7 (opt11)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18762 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut7 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18763 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut7 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18764 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut7 (opt2)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18765 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut7 (opt3)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18766 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut7 (opt4)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18767 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut7 (opt5)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18768 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut7 (opt6)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18769 - RNA, 1918 nt, synthetic construct
  misc_feature 1..1918: note = mRNA product Design a-3 comprising derived and/or modified sequence from HRSV(Memphis-37)__AIY60640.1__F-del_DSCav1_mut7 (opt11)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18770 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut7 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18771 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut7 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18772 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut7 (opt2)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18773 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut7 (opt3)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18774 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut7 (opt4)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18775 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut7 (opt5)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18776 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut7 (opt6)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18777 - RNA, 1867 nt, synthetic construct
  misc_feature 1..1867: note = mRNA product Design a-4 comprising derived and/or modified sequence from HRSV(Memphis-37)__AIY60640.1__F-del_DSCav1_mut7 (opt11)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18778 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut7 (opt1)
  source 1..1813: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18779 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut7 (opt1)
  source 1..1813: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18780 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut7 (opt2)
  source 1..1813: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18781 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut7 (opt3)
  source 1..1813: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18782 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut7 (opt4)
  source 1..1813: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18783 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut7 (opt5)
  source 1..1813: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18784 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut7 (opt6)
  source 1..1813: mol_type = other RNA
gggagactttcccattctgtagcagaatttggtgttgcctgtggtcttggtcccgcggagaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18785 - RNA, 1813 nt, synthetic construct
  misc_feature 1..1813: note = mRNA product Design a-5 comprising derived and/or modified sequence from HRSV(Memphis-37)__AIY60640.1__F-del_DSCav1_mut7 (opt11)
  source 1..1813: mol_type = other RNA
gggagactttcccattctgtagcagaatttggtgttgcctgtggtcttggtcccgcggagaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18786 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut7 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18787 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut7 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18788 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut7 (opt2)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18789 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut7 (opt3)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18790 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut7 (opt4)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18791 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut7 (opt5)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18792 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut7 (opt6)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18793 - RNA, 1994 nt, synthetic construct
  misc_feature 1..1994: note = mRNA product Design b-1 comprising derived and/or modified sequence from HRSV(Memphis-37)__AIY60640.1__F-del_DSCav1_mut7 (opt11)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18794 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut7 (opt1)
  source 1..1814: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18795 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut7 (opt1)
  source 1..1814: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18796 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut7 (opt2)
  source 1..1814: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18797 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut7 (opt3)
  source 1..1814: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18798 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut7 (opt4)
  source 1..1814: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18799 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut7 (opt5)
  source 1..1814: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18800 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut7 (opt6)
  source 1..1814: mol_type = other RNA
gggagagcctctgctggagtccggggagtggcgttggctgctagagcgaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18801 - RNA, 1814 nt, synthetic construct
  misc_feature 1..1814: note = mRNA product Design b-2 comprising derived and/or modified sequence from HRSV(Memphis-37)__AIY60640.1__F-del_DSCav1_mut7 (opt11)
  source 1..1814: mol_type = other RNA
gggagagcctctgctggagtccggggagtggcgttggctgctagagcgaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18802 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut7 (opt1)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18803 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut7 (opt1)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18804 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut7 (opt2)
  source 1..1834: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18805 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut7 (opt3)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18806 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut7 (opt4)
  source 1..1834: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18807 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut7 (opt5)
  source 1..1834: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18808 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut7 (opt6)
  source 1..1834: mol_type = other RNA
gggagagtcccgcagtcggcgtccagcggctctgcttgttcgtgtgtgtgtcgttgcaggccttattcaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18809 - RNA, 1834 nt, synthetic construct
  misc_feature 1..1834: note = mRNA product Design b-3 comprising derived and/or modified sequence from HRSV(Memphis-37)__AIY60640.1__F-del_DSCav1_mut7 (opt11)
  source 1..1834: mol_type = other RNA
gggagagtcccgcagtcggcgtccagcggctctgcttgttcgtgtgtgtgtcgttgcaggccttattcaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18810 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut7 (opt1)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18811 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut7 (opt1)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18812 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut7 (opt2)
  source 1..1885: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18813 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut7 (opt3)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18814 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut7 (opt4)
  source 1..1885: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18815 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut7 (opt5)
  source 1..1885: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18816 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut7 (opt6)
  source 1..1885: mol_type = other RNA
gggagagtcccgcagtcggcgtccagcggctctgcttgttcgtgtgtgtgtcgttgcaggccttattcaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18817 - RNA, 1885 nt, synthetic construct
  misc_feature 1..1885: note = mRNA product Design b-4 comprising derived and/or modified sequence from HRSV(Memphis-37)__AIY60640.1__F-del_DSCav1_mut7 (opt11)
  source 1..1885: mol_type = other RNA
gggagagtcccgcagtcggcgtccagcggctctgcttgttcgtgtgtgtgtcgttgcaggccttattcaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18818 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut7 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18819 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut7 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18820 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut7 (opt2)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18821 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut7 (opt3)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18822 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut7 (opt4)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18823 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut7 (opt5)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18824 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut7 (opt6)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18825 - RNA, 1947 nt, synthetic construct
  misc_feature 1..1947: note = mRNA product Design b-5 comprising derived and/or modified sequence from HRSV(Memphis-37)__AIY60640.1__F-del_DSCav1_mut7 (opt11)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18826 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut7 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18827 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut7 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18828 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut7 (opt2)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18829 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut7 (opt3)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18830 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut7 (opt4)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18831 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut7 (opt5)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18832 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut7 (opt6)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18833 - RNA, 1853 nt, synthetic construct
  misc_feature 1..1853: note = mRNA product Design c-1 comprising derived and/or modified sequence from HRSV(Memphis-37)__AIY60640.1__F-del_DSCav1_mut7 (opt11)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18834 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut7 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18835 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut7 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18836 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut7 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18837 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut7 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18838 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut7 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18839 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut7 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18840 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut7 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18841 - RNA, 1943 nt, synthetic construct
  misc_feature 1..1943: note = mRNA product Design c-2 comprising derived and/or modified sequence from HRSV(Memphis-37)__AIY60640.1__F-del_DSCav1_mut7 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18842 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut7 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18843 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut7 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18844 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut7 (opt2)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18845 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut7 (opt3)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18846 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut7 (opt4)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18847 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut7 (opt5)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18848 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut7 (opt6)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18849 - RNA, 1920 nt, synthetic construct
  misc_feature 1..1920: note = mRNA product Design c-3 comprising derived and/or modified sequence from HRSV(Memphis-37)__AIY60640.1__F-del_DSCav1_mut7 (opt11)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18850 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut7 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18851 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut7 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18852 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut7 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18853 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut7 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18854 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut7 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18855 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut7 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18856 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut7 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18857 - RNA, 1916 nt, synthetic construct
  misc_feature 1..1916: note = mRNA product Design c-4 comprising derived and/or modified sequence from HRSV(Memphis-37)__AIY60640.1__F-del_DSCav1_mut7 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18858 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut7 (opt1)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18859 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut7 (opt1)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18860 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut7 (opt2)
  source 1..1834: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18861 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut7 (opt3)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18862 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut7 (opt4)
  source 1..1834: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18863 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut7 (opt5)
  source 1..1834: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18864 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut7 (opt6)
  source 1..1834: mol_type = other RNA
gggagagcggctcggccattttgtcccagtcagtccggaggctgcggctgcagaagtaccgcctgcggagtaactgcaaagaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18865 - RNA, 1834 nt, synthetic construct
  misc_feature 1..1834: note = mRNA product Design c-5 comprising derived and/or modified sequence from HRSV(Memphis-37)__AIY60640.1__F-del_DSCav1_mut7 (opt11)
  source 1..1834: mol_type = other RNA
gggagagcggctcggccattttgtcccagtcagtccggaggctgcggctgcagaagtaccgcctgcggagtaactgcaaagaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18866 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut7 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18867 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut7 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18868 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut7 (opt2)
  source 1..1843: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18869 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut7 (opt3)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18870 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut7 (opt4)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18871 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut7 (opt5)
  source 1..1843: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18872 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut7 (opt6)
  source 1..1843: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18873 - RNA, 1843 nt, synthetic construct
  misc_feature 1..1843: note = mRNA product Design d-1 comprising derived and/or modified sequence from HRSV(Memphis-37)__AIY60640.1__F-del_DSCav1_mut7 (opt11)
  source 1..1843: mol_type = other RNA
gggagacccgtgacccggaagttgtacggctacgcgactttccctcccacaaaccctcgcgcccttcctttcctacttgggcccggcagaaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18874 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut7 (opt1)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18875 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut7 (opt1)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18876 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut7 (opt2)
  source 1..1898: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18877 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut7 (opt3)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18878 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut7 (opt4)
  source 1..1898: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18879 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut7 (opt5)
  source 1..1898: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18880 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut7 (opt6)
  source 1..1898: mol_type = other RNA
gggagagcggctcggccattttgtcccagtcagtccggaggctgcggctgcagaagtaccgcctgcggagtaactgcaaagaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18881 - RNA, 1898 nt, synthetic construct
  misc_feature 1..1898: note = mRNA product Design d-2 comprising derived and/or modified sequence from HRSV(Memphis-37)__AIY60640.1__F-del_DSCav1_mut7 (opt11)
  source 1..1898: mol_type = other RNA
gggagagcggctcggccattttgtcccagtcagtccggaggctgcggctgcagaagtaccgcctgcggagtaactgcaaagaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18882 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut7 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18883 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut7 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18884 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut7 (opt2)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18885 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut7 (opt3)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18886 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut7 (opt4)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18887 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut7 (opt5)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18888 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut7 (opt6)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18889 - RNA, 2214 nt, synthetic construct
  misc_feature 1..2214: note = mRNA product Design d-3 comprising derived and/or modified sequence from HRSV(Memphis-37)__AIY60640.1__F-del_DSCav1_mut7 (opt11)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18890 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut7 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18891 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut7 (opt1)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18892 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut7 (opt2)
  source 1..1897: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18893 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut7 (opt3)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18894 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut7 (opt4)
  source 1..1897: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18895 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut7 (opt5)
  source 1..1897: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18896 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut7 (opt6)
  source 1..1897: mol_type = other RNA
gggagagtcccgcagtcggcgtccagcggctctgcttgttcgtgtgtgtgtcgttgcaggccttattcaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18897 - RNA, 1897 nt, synthetic construct
  misc_feature 1..1897: note = mRNA product Design d-4 comprising derived and/or modified sequence from HRSV(Memphis-37)__AIY60640.1__F-del_DSCav1_mut7 (opt11)
  source 1..1897: mol_type = other RNA
gggagagtcccgcagtcggcgtccagcggctctgcttgttcgtgtgtgtgtcgttgcaggccttattcaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18898 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut7 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18899 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut7 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18900 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut7 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18901 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut7 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18902 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut7 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18903 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut7 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18904 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut7 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18905 - RNA, 1994 nt, synthetic construct
  misc_feature 1..1994: note = mRNA product Design d-5 comprising derived and/or modified sequence from HRSV(Memphis-37)__AIY60640.1__F-del_DSCav1_mut7 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18906 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut7 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18907 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut7 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18908 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut7 (opt2)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18909 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut7 (opt3)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18910 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut7 (opt4)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18911 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut7 (opt5)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18912 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut7 (opt6)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18913 - RNA, 1874 nt, synthetic construct
  misc_feature 1..1874: note = mRNA product Design e-1 comprising derived and/or modified sequence from HRSV(Memphis-37)__AIY60640.1__F-del_DSCav1_mut7 (opt11)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18914 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut7 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18915 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut7 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18916 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut7 (opt2)
  source 1..1856: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18917 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut7 (opt3)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18918 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut7 (opt4)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18919 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut7 (opt5)
  source 1..1856: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18920 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut7 (opt6)
  source 1..1856: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18921 - RNA, 1856 nt, synthetic construct
  misc_feature 1..1856: note = mRNA product Design e-2 comprising derived and/or modified sequence from HRSV(Memphis-37)__AIY60640.1__F-del_DSCav1_mut7 (opt11)
  source 1..1856: mol_type = other RNA
gggagacccgtgacccggaagttgtacggctacgcgactttccctcccacaaaccctcgcgcccttcctttcctacttgggcccggcagaaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18922 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut7 (opt1)
  source 1..1826: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18923 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut7 (opt1)
  source 1..1826: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18924 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut7 (opt2)
  source 1..1826: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18925 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut7 (opt3)
  source 1..1826: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18926 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut7 (opt4)
  source 1..1826: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18927 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut7 (opt5)
  source 1..1826: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18928 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut7 (opt6)
  source 1..1826: mol_type = other RNA
gggagactttcccattctgtagcagaatttggtgttgcctgtggtcttggtcccgcggagaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18929 - RNA, 1826 nt, synthetic construct
  misc_feature 1..1826: note = mRNA product Design e-3 comprising derived and/or modified sequence from HRSV(Memphis-37)__AIY60640.1__F-del_DSCav1_mut7 (opt11)
  source 1..1826: mol_type = other RNA
gggagactttcccattctgtagcagaatttggtgttgcctgtggtcttggtcccgcggagaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18930 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut7 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18931 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut7 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18932 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut7 (opt2)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18933 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut7 (opt3)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18934 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut7 (opt4)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18935 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut7 (opt5)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18936 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut7 (opt6)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18937 - RNA, 1880 nt, synthetic construct
  misc_feature 1..1880: note = mRNA product Design e-4 comprising derived and/or modified sequence from HRSV(Memphis-37)__AIY60640.1__F-del_DSCav1_mut7 (opt11)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18938 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut7 (opt1)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18939 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut7 (opt1)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18940 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut7 (opt2)
  source 1..1847: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18941 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut7 (opt3)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18942 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut7 (opt4)
  source 1..1847: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18943 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut7 (opt5)
  source 1..1847: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18944 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut7 (opt6)
  source 1..1847: mol_type = other RNA
gggagagcggctcggccattttgtcccagtcagtccggaggctgcggctgcagaagtaccgcctgcggagtaactgcaaagaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18945 - RNA, 1847 nt, synthetic construct
  misc_feature 1..1847: note = mRNA product Design e-5 comprising derived and/or modified sequence from HRSV(Memphis-37)__AIY60640.1__F-del_DSCav1_mut7 (opt11)
  source 1..1847: mol_type = other RNA
gggagagcggctcggccattttgtcccagtcagtccggaggctgcggctgcagaagtaccgcctgcggagtaactgcaaagaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18946 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut7 (opt1)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18947 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut7 (opt1)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18948 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut7 (opt2)
  source 1..1914: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18949 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut7 (opt3)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18950 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut7 (opt4)
  source 1..1914: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18951 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut7 (opt5)
  source 1..1914: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18952 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut7 (opt6)
  source 1..1914: mol_type = other RNA
gggagagcggctcggccattttgtcccagtcagtccggaggctgcggctgcagaagtaccgcctgcggagtaactgcaaagaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18953 - RNA, 1914 nt, synthetic construct
  misc_feature 1..1914: note = mRNA product Design e-6 comprising derived and/or modified sequence from HRSV(Memphis-37)__AIY60640.1__F-del_DSCav1_mut7 (opt11)
  source 1..1914: mol_type = other RNA
gggagagcggctcggccattttgtcccagtcagtccggaggctgcggctgcagaagtaccgcctgcggagtaactgcaaagaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18954 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut7 (opt1)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18955 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut7 (opt1)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18956 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut7 (opt2)
  source 1..2130: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18957 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut7 (opt3)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18958 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut7 (opt4)
  source 1..2130: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18959 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut7 (opt5)
  source 1..2130: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18960 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut7 (opt6)
  source 1..2130: mol_type = other RNA
gggagagcggctcggccattttgtcccagtcagtccggaggctgcggctgcagaagtaccgcctgcggagtaactgcaaagaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18961 - RNA, 2130 nt, synthetic construct
  misc_feature 1..2130: note = mRNA product Design f-1 comprising derived and/or modified sequence from HRSV(Memphis-37)__AIY60640.1__F-del_DSCav1_mut7 (opt11)
  source 1..2130: mol_type = other RNA
gggagagcggctcggccattttgtcccagtcagtccggaggctgcggctgcagaagtaccgcctgcggagtaactgcaaagaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18962 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut7 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18963 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut7 (opt1)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18964 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut7 (opt2)
  source 1..1910: mol_type = other RNA
gggagagcggctcggccattttgtcccagtcagtccggaggctgcggctgcagaagtaccgcctgcggagtaactgcaaagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18965 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut7 (opt3)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18966 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut7 (opt4)
  source 1..1910: mol_type = other RNA
gggagagcggctcggccattttgtcccagtcagtccggaggctgcggctgcagaagtaccgcctgcggagtaactgcaaagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18967 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut7 (opt5)
  source 1..1910: mol_type = other RNA
gggagagcggctcggccattttgtcccagtcagtccggaggctgcggctgcagaagtaccgcctgcggagtaactgcaaagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18968 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut7 (opt6)
  source 1..1910: mol_type = other RNA
gggagagcggctcggccattttgtcccagtcagtccggaggctgcggctgcagaagtaccgcctgcggagtaactgcaaagaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18969 - RNA, 1910 nt, synthetic construct
  misc_feature 1..1910: note = mRNA product Design f-2 comprising derived and/or modified sequence from HRSV(Memphis-37)__AIY60640.1__F-del_DSCav1_mut7 (opt11)
  source 1..1910: mol_type = other RNA
gggagagcggctcggccattttgtcccagtcagtccggaggctgcggctgcagaagtaccgcctgcggagtaactgcaaagaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18970 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut7 (opt1)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18971 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut7 (opt1)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18972 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut7 (opt2)
  source 1..1901: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18973 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut7 (opt3)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18974 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut7 (opt4)
  source 1..1901: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18975 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut7 (opt5)
  source 1..1901: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18976 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut7 (opt6)
  source 1..1901: mol_type = other RNA
gggagagtcccgcagtcggcgtccagcggctctgcttgttcgtgtgtgtgtcgttgcaggccttattcaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18977 - RNA, 1901 nt, synthetic construct
  misc_feature 1..1901: note = mRNA product Design f-3 comprising derived and/or modified sequence from HRSV(Memphis-37)__AIY60640.1__F-del_DSCav1_mut7 (opt11)
  source 1..1901: mol_type = other RNA
gggagagtcccgcagtcggcgtccagcggctctgcttgttcgtgtgtgtgtcgttgcaggccttattcaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18978 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut7 (opt1)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18979 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut7 (opt1)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18980 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut7 (opt2)
  source 1..2117: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18981 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut7 (opt3)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18982 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut7 (opt4)
  source 1..2117: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18983 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut7 (opt5)
  source 1..2117: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18984 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut7 (opt6)
  source 1..2117: mol_type = other RNA
gggagagtcccgcagtcggcgtccagcggctctgcttgttcgtgtgtgtgtcgttgcaggccttattcaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18985 - RNA, 2117 nt, synthetic construct
  misc_feature 1..2117: note = mRNA product Design f-4 comprising derived and/or modified sequence from HRSV(Memphis-37)__AIY60640.1__F-del_DSCav1_mut7 (opt11)
  source 1..2117: mol_type = other RNA
gggagagtcccgcagtcggcgtccagcggctctgcttgttcgtgtgtgtgtcgttgcaggccttattcaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18986 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut7 (opt1)
  source 1..1893: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18987 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut7 (opt1)
  source 1..1893: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18988 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut7 (opt2)
  source 1..1893: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18989 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut7 (opt3)
  source 1..1893: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18990 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut7 (opt4)
  source 1..1893: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18991 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut7 (opt5)
  source 1..1893: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18992 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut7 (opt6)
  source 1..1893: mol_type = other RNA
gggagactttcccattctgtagcagaatttggtgttgcctgtggtcttggtcccgcggagaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18993 - RNA, 1893 nt, synthetic construct
  misc_feature 1..1893: note = mRNA product Design f-5 comprising derived and/or modified sequence from HRSV(Memphis-37)__AIY60640.1__F-del_DSCav1_mut7 (opt11)
  source 1..1893: mol_type = other RNA
gggagactttcccattctgtagcagaatttggtgttgcctgtggtcttggtcccgcggagaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18994 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut7 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18995 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut7 (opt1)
  source 1..1889: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18996 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut7 (opt2)
  source 1..1889: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18997 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut7 (opt3)
  source 1..1889: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18998 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut7 (opt4)
  source 1..1889: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 18999 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut7 (opt5)
  source 1..1889: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19000 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut7 (opt6)
  source 1..1889: mol_type = other RNA
gggagactttcccattctgtagcagaatttggtgttgcctgtggtcttggtcccgcggagaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19001 - RNA, 1889 nt, synthetic construct
  misc_feature 1..1889: note = mRNA product Design g-1 comprising derived and/or modified sequence from HRSV(Memphis-37)__AIY60640.1__F-del_DSCav1_mut7 (opt11)
  source 1..1889: mol_type = other RNA
gggagactttcccattctgtagcagaatttggtgttgcctgtggtcttggtcccgcggagaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19002 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut7 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19003 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut7 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19004 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut7 (opt2)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19005 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut7 (opt3)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19006 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut7 (opt4)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19007 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut7 (opt5)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19008 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut7 (opt6)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19009 - RNA, 1904 nt, synthetic construct
  misc_feature 1..1904: note = mRNA product Design g-2 comprising derived and/or modified sequence from HRSV(Memphis-37)__AIY60640.1__F-del_DSCav1_mut7 (opt11)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19010 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut7 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19011 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut7 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19012 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut7 (opt2)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19013 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut7 (opt3)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19014 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut7 (opt4)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19015 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut7 (opt5)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19016 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut7 (opt6)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19017 - RNA, 2136 nt, synthetic construct
  misc_feature 1..2136: note = mRNA product Design g-3 comprising derived and/or modified sequence from HRSV(Memphis-37)__AIY60640.1__F-del_DSCav1_mut7 (opt11)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19018 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut7 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19019 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut7 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19020 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut7 (opt2)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19021 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut7 (opt3)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19022 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut7 (opt4)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19023 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut7 (opt5)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19024 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut7 (opt6)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19025 - RNA, 1931 nt, synthetic construct
  misc_feature 1..1931: note = mRNA product Design g-4 comprising derived and/or modified sequence from HRSV(Memphis-37)__AIY60640.1__F-del_DSCav1_mut7 (opt11)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19026 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut7 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19027 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut7 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19028 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut7 (opt2)
  source 1..1907: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19029 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut7 (opt3)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19030 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut7 (opt4)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19031 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut7 (opt5)
  source 1..1907: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19032 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut7 (opt6)
  source 1..1907: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19033 - RNA, 1907 nt, synthetic construct
  misc_feature 1..1907: note = mRNA product Design g-5 comprising derived and/or modified sequence from HRSV(Memphis-37)__AIY60640.1__F-del_DSCav1_mut7 (opt11)
  source 1..1907: mol_type = other RNA
gggagacccgtgacccggaagttgtacggctacgcgactttccctcccacaaaccctcgcgcccttcctttcctacttgggcccggcagaaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19034 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut7 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19035 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut7 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19036 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut7 (opt2)
  source 1..1923: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19037 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut7 (opt3)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19038 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut7 (opt4)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19039 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut7 (opt5)
  source 1..1923: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19040 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut7 (opt6)
  source 1..1923: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19041 - RNA, 1923 nt, synthetic construct
  misc_feature 1..1923: note = mRNA product Design h-1 comprising derived and/or modified sequence from HRSV(Memphis-37)__AIY60640.1__F-del_DSCav1_mut7 (opt11)
  source 1..1923: mol_type = other RNA
gggagacccgtgacccggaagttgtacggctacgcgactttccctcccacaaaccctcgcgcccttcctttcctacttgggcccggcagaaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19042 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut7 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19043 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut7 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19044 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut7 (opt2)
  source 1..2139: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19045 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut7 (opt3)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19046 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut7 (opt4)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19047 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut7 (opt5)
  source 1..2139: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19048 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut7 (opt6)
  source 1..2139: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19049 - RNA, 2139 nt, synthetic construct
  misc_feature 1..2139: note = mRNA product Design h-2 comprising derived and/or modified sequence from HRSV(Memphis-37)__AIY60640.1__F-del_DSCav1_mut7 (opt11)
  source 1..2139: mol_type = other RNA
gggagacccgtgacccggaagttgtacggctacgcgactttccctcccacaaaccctcgcgcccttcctttcctacttgggcccggcagaaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19050 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut7 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19051 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut7 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19052 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut7 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19053 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut7 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19054 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut7 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19055 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut7 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19056 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut7 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19057 - RNA, 1919 nt, synthetic construct
  misc_feature 1..1919: note = mRNA product Design h-3 comprising derived and/or modified sequence from HRSV(Memphis-37)__AIY60640.1__F-del_DSCav1_mut7 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19058 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut7 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19059 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut7 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19060 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut7 (opt2)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19061 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut7 (opt3)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19062 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut7 (opt4)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19063 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut7 (opt5)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19064 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut7 (opt6)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19065 - RNA, 1982 nt, synthetic construct
  misc_feature 1..1982: note = mRNA product Design h-4 comprising derived and/or modified sequence from HRSV(Memphis-37)__AIY60640.1__F-del_DSCav1_mut7 (opt11)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19066 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut7 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19067 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut7 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19068 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut7 (opt2)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19069 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut7 (opt3)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19070 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut7 (opt4)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19071 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut7 (opt5)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19072 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut7 (opt6)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19073 - RNA, 1998 nt, synthetic construct
  misc_feature 1..1998: note = mRNA product Design h-5 comprising derived and/or modified sequence from HRSV(Memphis-37)__AIY60640.1__F-del_DSCav1_mut7 (opt11)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19074 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut7 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19075 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut7 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19076 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut7 (opt2)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19077 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut7 (opt3)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19078 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut7 (opt4)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19079 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut7 (opt5)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19080 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut7 (opt6)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19081 - RNA, 1931 nt, synthetic construct
  misc_feature 1..1931: note = mRNA product Design i-1 comprising derived and/or modified sequence from HRSV(Memphis-37)__AIY60640.1__F-del_DSCav1_mut7 (opt11)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19082 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut7 (opt1)
  source 1..1931: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19083 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut7 (opt1)
  source 1..1931: mol_type = other RNA
gggagaggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19084 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut7 (opt2)
  source 1..1931: mol_type = other RNA
gggagaggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19085 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut7 (opt3)
  source 1..1931: mol_type = other RNA
gggagaggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19086 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut7 (opt4)
  source 1..1931: mol_type = other RNA
gggagaggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19087 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut7 (opt5)
  source 1..1931: mol_type = other RNA
gggagaggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19088 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut7 (opt6)
  source 1..1931: mol_type = other RNA
gggagaggcgctgcctacggaggtggcagccatctccttctcggcatcaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19089 - RNA, 1931 nt, synthetic construct
  misc_feature 1..1931: note = mRNA product Design i-2 comprising derived and/or modified sequence from HRSV(Memphis-37)__AIY60640.1__F-del_DSCav1_mut7 (opt11)
  source 1..1931: mol_type = other RNA
gggagaggcgctgcctacggaggtggcagccatctccttctcggcatcaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19090 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut7 (opt1)
  source 1..1927: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19091 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut7 (opt1)
  source 1..1927: mol_type = other RNA
ggggcgctgcctacggaggtggcagccatctccttctcggcatcaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19092 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut7 (opt2)
  source 1..1927: mol_type = other RNA
ggggcgctgcctacggaggtggcagccatctccttctcggcatcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19093 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut7 (opt3)
  source 1..1927: mol_type = other RNA
ggggcgctgcctacggaggtggcagccatctccttctcggcatcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19094 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut7 (opt4)
  source 1..1927: mol_type = other RNA
ggggcgctgcctacggaggtggcagccatctccttctcggcatcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19095 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut7 (opt5)
  source 1..1927: mol_type = other RNA
ggggcgctgcctacggaggtggcagccatctccttctcggcatcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19096 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut7 (opt6)
  source 1..1927: mol_type = other RNA
ggggcgctgcctacggaggtggcagccatctccttctcggcatcaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19097 - RNA, 1927 nt, synthetic construct
  misc_feature 1..1927: note = mRNA product Design i-2 comprising derived and/or modified sequence from HRSV(Memphis-37)__AIY60640.1__F-del_DSCav1_mut7 (opt11)
  source 1..1927: mol_type = other RNA
ggggcgctgcctacggaggtggcagccatctccttctcggcatcaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19098 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut7 (opt1)
  source 1..1762: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctgatgtgcagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccaacggggtgagcgtcctgaccttcaaggtgctggacctcaagaactacatcgacaagcagctgctgcccatcctgaacaagcagagctgctccatcagcaacatcgagaccgtcatggagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtctgcagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagaacaagggcatcatcaagaccttctccaacgggtgcgactacgtcagcaacaagggcgtggacaccgtgtccgtcggcaacaccctgtactacgtgaacaagcaggagggcaagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19099 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut7 (opt1)
  source 1..1762: mol_type = other RNA
gggagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaaggggtacctctccgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggagctgcagatgctcatgtgcagcaccccggccgccgggtccggcagcgccatcgcgtccgggatcgccgtgtgcaaggtgctgcacctggagggcgaggtcaacaagatcaagaacgccctcctgagcaccaacaaggccgtggtgtccctgagcaacggcgtctccgtgctcaccttcaaggtgctggacctgaagaactacatcgacaagcagctcctgcccatcctgaacaagcagagctgctccatcagcaacatcgagacggtcatggagttccagcagaagaacaaccggctcctggagatcacccgcgagttctccgtgaacgccggggtgaccacccccgtcagcacgtacatgctgaccaacagcgagctcctgtccctgatcaacgacatgcccatcaccaacgaccagaagaagctcatgagcaacaacgtgcagatcgtgcggcagcagtcctacagcatcatgtgcatcatcaaggaggaggtcctggcgtacgtggtgcagctgccgctctacggcgtcatcgacaccccctgctggaagctgcacacgagccccctgtgcaccaccaacaccaaggaggggagcaacatctgcctcacgcgcaccgaccggggctggtactgcgacaacgccgggtccgtgagcttcttcccccaggccgagacctgcaaggtgtgctccaaccgcgtcttctgcgacaccatgaacagcctgacgctgccgtccgaggtgaacctctgcaacatcgacatcttcaaccccaagtacgactgcaagatcatgaccagcaagaccgacgtctccagctccgtgatcaccagcctgggcgccatcgtgtcctgctacggcaagacgaagtgcaccgccagcaacaagaacaaggggatcatcaagaccttctccaacggctgcgactacgtcagcaacaagggggtggacaccgtgagcgtcggcaacacgctgtactacgtgaacaagcaggagggcaagtccctctacgtgaagggggagcccatcatcaacttctacgaccccctggtcttcccgagcgacgagttcgacgcgtccatcagccaggtgaacgagaagatcaaccagtccctggccttcatccggaagtccgacgagctcctgcacaacgtgaacgtcggcaagtccaccaccaacatcatgatcaccaccatcatcatcgtgatcatcgtgatcctgctcctgctgatcgccgtcggcctcttcctgtactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19100 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut7 (opt2)
  source 1..1762: mol_type = other RNA
gggagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagatgctcatgtgctccacccccgccgccggctccggctccgccatcgcctccggcatcgccgtctgcaaggtcctccacctcgagggcgaggtcaacaagatcaagaacgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19101 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut7 (opt3)
  source 1..1762: mol_type = other RNA
gggagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgagcgctttaagaactgggtggtacacctccgttattacaatcgaactgtctaacattaaggagaataaatgcaacggaaccgacgccaaggtgaaactaatcaagcaggaactcgataagtataaaaatgcagtaactgagctgcagatgcttatgtgttcgacccctgccgctggttcaggcagcgcaatagccagtgggatcgctgtgtgcaaggtcctgcacttggagggagaagtgaacaaaattaagaatgccctcctgtccacaaacaaagcggttgtgtctctgagcaatggcgtctccgtgctcacgttcaaggtattagacctgaagaactacatcgataaacagcttttgccaattctgaataagcaatcatgtagtatcagcaacatagagactgttatggaatttcagcagaaaaataacaggctactcgagattacccgggagttctctgtgaatgccggtgtcacaactccggtgtccacctatatgctgacaaactcagaacttctgagcttgatcaacgacatgcccattaccaatgatcagaagaaactcatgagtaacaatgtgcaaatcgtccgccagcagtcttactccatcatgtgcattataaaggaggaagttctggcatatgtggtacagttacctctgtacggggtgatcgacacgccatgttggaaactccatactagccccctttgcacaaccaacactaaggagggatcgaatatttgtctgacacgaaccgatcgtggctggtactgcgacaacgctggctctgtctcctttttccctcaagccgaaacgtgtaaggtgtgctcaaatagagtgttttgcgataccatgaacagtttgacactaccaagcgaggttaatctgtgtaacatcgacatattcaatcccaaatatgattgcaagattatgacttccaaaaccgacgtctctagctcagtgatcacaagtctcggggcaatcgtatcctgttacggaaagactaaatgcaccgctagcaacaagaataagggtattatcaaaacattttctaacggctgtgattatgtttcaaataagggggtggacaccgtcagtgtgggaaacactctgtactatgtcaacaaacaggagggcaagagcctttacgtgaaaggtgaacctattataaatttctatgacccactggtttttccgtccgatgagttcgacgcctctatcagccaggtgaacgaaaagattaatcaatcgttggcgtttatcaggaagtccgatgagctcctgcacaacgtaaatgtcgggaaatcaacgacaaacatcatgattaccactataatcattgtgatcattgttatcttactgctactcatagccgtgggactgttcctttactgcaaggcacggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19102 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut7 (opt4)
  source 1..1762: mol_type = other RNA
gggagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagatgctgatgtgcagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19103 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut7 (opt5)
  source 1..1762: mol_type = other RNA
gggagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgtctgccctcagaacagggtggtacaccagcgttatcacaattgaactgtccaacatcaaggagaataaatgcaacggaaccgacgccaaggtgaaacttatcaagcaggaactggataagtataaaaatgctgtgacggagctccagatgctgatgtgttctacccctgccgctggcagcgggtccgccattgcgagcggaatcgccgtctgcaaggtgctgcacctcgagggcgaagttaacaaaattaagaatgctctgctttctacaaacaaagccgtggtctccctgagcaatggggtgtctgttctcaccttcaaggtgctggaccttaagaactacatcgataaacagctgctcccgattctgaataagcaatcctgtagcatctctaacattgagacagtcatggaatttcagcagaaaaataaccggctgctcgagatcacccgcgagttctccgtgaatgctggagtgacgacacccgtcagcacctatatgctgacaaactccgaacttctgtctctcatcaacgacatgcctattaccaatgatcagaagaaactgatgagcaacaatgttcaaatcgtgagacagcagtcctacagcattatgtgcatcattaaggaggaagtgcttgcctatgtcgtgcagctgcccctctacggcgttatcgacaccccttgttggaaactgcatacatctcccctgtgcacgaccaacacaaaggagggctccaatatctgtctcacccggacagatcgcgggtggtactgcgacaacgcgggaagcgtgagctttttccctcaagccgaaacctgtaaggtctgctctaatagagtgttttgcgatacgatgaactccctgacacttccgtctgaggttaatctgtgtaacattgacatcttcaatcccaaatatgattgcaagattatgaccagcaaaaccgacgtgtccagctctgtcatcacatccctcggcgctattgtgagctgttacgggaagaccaaatgcacagcctctaacaagaataagggaatcatcaaaacgttttccaacggctgtgattatgtcagcaataagggggtggacaccgtttccgtgggaaacacactgtactatgtcaacaaacaggagggcaagtctctttacgtgaaaggcgaacctattatcaatttctatgaccccctggtttttcctagcgatgagttcgacgcttccatttctcaggtgaacgaaaagatcaatcaaagcctcgcctttattcggaagtccgatgagctgctgcacaacgtcaatgtggggaaaagcaccacaaacatcatgattaccacgatcatcattgtgatcattgttatcctcctgcttctgattgccgtcggactcttcctgtactgcaaggctcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19104 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut7 (opt6)
  source 1..1762: mol_type = other RNA
gggagaaagcttaccatggaactaccaatactcaaaacaaacgccataaccacaatactagccgcagtaacactttgctttgcctcaagtcaaaacataacagaagaattttaccaatccacatgctcagctgtatccaaaggatatttatccgcactaagaacaggatggtacacatcagtaatcacaatagaattatcaaacataaaagaaaacaaatgtaatggcacagacgccaaagtaaaactaattaaacaagaactagacaaatataaaaatgcagtaaccgaactccaaatgctcatgtgctctacaccagctgcaggatcaggatcagccattgcaagcggtatagctgtttgcaaagtattacacttagaaggagaagtaaataaaataaaaaacgcactactatcaacaaataaagcagtagtatccctatcaaacggagtatcagtacttacattcaaagtattagatttaaaaaactatatagacaaacaactacttcccatattaaacaaacaatcatgctcaatttccaacattgaaactgtaatggaatttcaacaaaaaaacaacagactacttgaaatcacacgagaattttcagtaaacgctggagtaacaacacctgtctctacctacatgctcacaaatagcgaattactatctctaatcaatgacatgccaataacaaacgatcaaaaaaaactaatgtccaacaacgtacaaatagtaagacaacaatcctattcaataatgtgcataataaaagaagaagtcttagcatacgttgtacaactaccattatacggagtaatagatacaccatgctggaaactccacacaagccccctctgcacaacaaacaccaaagaagggtcaaacatatgcttaacaagaacagacagaggatggtactgtgataacgcaggatctgtctcattctttccacaagcagaaacatgtaaagtatgctccaacagagtcttttgcgacaccatgaactcactaaccttaccctcagaagtaaacctgtgcaacatcgatatcttcaaccccaaatacgattgcaaaatcatgacaagcaaaactgatgtatccagctctgtaataacatcactaggtgcaatagtatcatgctacggaaaaacaaaatgcacagcttctaacaaaaataaaggaataataaaaacattctccaatggatgcgactatgtctcaaataaaggagtagatacagtttcagtcggcaacacactctattatgtaaataaacaagaaggaaaatcattatacgtaaaaggagaacccataataaacttctacgaccccctcgtattcccaagcgacgaatttgacgcctcaatatcacaagtaaacgaaaaaataaaccaatcactcgcattcatcagaaaatcagatgaactactacacaatgtaaacgtcggaaaatccaccacaaatataatgataactaccatcataatagtaataatagtcatcttactactattaatcgctgtaggactatttctctactgcaaggccagataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19105 - RNA, 1762 nt, synthetic construct
  misc_feature 1..1762: note = mRNA product Design i-3 comprising derived and/or modified sequence from HRSV(Memphis-37)__AIY60640.1__F-del_DSCav1_mut7 (opt11)
  source 1..1762: mol_type = other RNA
gggagaaagcttaccatggaactcccaatcctcaaaacaaatgccatcaccaccatcctagccgctgtcacactatgcttcgcctcctcacaaaacatcaccgaagagttctatcaatccacatgctccgccgtcagcaagggatacctctccgcccttagaaccggctggtacacctcagtcatcacaattgaactgtcaaacatcaaagaaaacaaatgcaacggcaccgacgcaaaagtaaagctcatcaaacaagaactggacaagtacaagaacgccgtcaccgaactacagatgcttatgtgctcaacccctgccgccggctccggatctgccatagcttcaggcatcgccgtatgcaaagtcctgcacctagaaggggaagtcaacaaaatcaaaaacgccctcctctccaccaacaaggccgttgtctccctgtcaaacggagtctccgtcctaaccttcaaagtcctcgacctcaaaaactacatagacaaacaactcctacccatcctcaacaaacaaagctgctcaatatccaacatcgaaaccgtcatggagttccaacaaaagaacaaccgactactcgaaataacacgcgagttctcagtcaacgccggcgtcaccaccccagtctccacatacatgctcaccaactccgaactcctatcgctcatcaacgacatgcccatcaccaatgaccagaagaaactcatgtccaacaacgtacaaatcgtccgccaacagtcctactcaatcatgtgcatcatcaaagaagaagtccttgcctacgtcgtccagcttccactctacggagtcatcgacaccccctgctggaaactccacacctccccactatgcaccaccaacaccaaagaaggatccaacatatgcctcacccgtactgaccgcggctggtactgcgacaacgccggatccgtctcattcttcccccaggccgaaacctgcaaagtctgctccaaccgcgtcttctgcgacaccatgaactcgctcaccctcccatccgaagtcaatctatgcaacatcgacattttcaaccccaaatacgactgcaaaattatgacatcaaaaaccgacgtctcatcctcagtcatcacttccctcggcgcaatcgtaagctgctacgggaaaacaaagtgcaccgcttccaacaaaaacaaaggcatcatcaaaaccttctctaacggctgcgactacgtctccaacaaaggagtcgacaccgtatccgtcggcaacaccctctactacgtcaacaaacaggaaggaaaatcgctctacgtcaaaggagaaccaatcatcaacttctacgaccccctagtcttcccatccgacgagttcgacgccagcatctcacaagtcaatgaaaagatcaaccagtcactcgcattcatccgtaagtcagacgaactcctacacaacgtcaacgtcggcaagtcaacaaccaacataatgatcaccaccataatcatcgtcataatagtaatcctccttctcctaatcgcagtcggcctcttcctctactgcaaagcacgctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19106 - protein, 536 aa, synthetic construct
  REGION 1..536: note = derived and/or modified protein sequence (artificial) from HRSV(Memphis-37)__AIY60640.1__F_DSCav1_mut8
MELPILKTNAITTILAAVTLCFASSQNITEEFYQSTCSAVSKGYLGALRTGWYTSVITIELSNIKEIKCNGTDAKVKLIKQELDKYKNAVTDLQLLMQSTPAAGSGSAIASGIAVCKVLHLEGEVNKIKNALLSTNKAVVSLSGCGVSVLTFKVLDLKNYIDKQLLPILNKQSCSIPNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKCRGIIKTFSNGCDYVSNKGVDTVSVGNTLYYVNKQEGQSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 19107 - RNA, 1611 nt, synthetic construct
  misc_feature 1..1611: note = derived and/or modified CDS sequence (opt1) from HRSV(Memphis-37)__AIY60640.1__F_DSCav1_mut8
  source 1..1611: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactga

SEQ ID NO: 19108 - RNA, 1611 nt, synthetic construct
  misc_feature 1..1611: note = derived and/or modified CDS sequence (opt1) from HRSV(Memphis-37)__AIY60640.1__F_DSCav1_mut8
  source 1..1611: mol_type = other RNA
atggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactga

SEQ ID NO: 19109 - RNA, 1611 nt, synthetic construct
  misc_feature 1..1611: note = derived and/or modified CDS sequence (opt2) from HRSV(Memphis-37)__AIY60640.1__F_DSCav1_mut8
  source 1..1611: mol_type = other RNA
atggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactga

SEQ ID NO: 19110 - RNA, 1611 nt, synthetic construct
  misc_feature 1..1611: note = derived and/or modified CDS sequence (opt3) from HRSV(Memphis-37)__AIY60640.1__F_DSCav1_mut8
  source 1..1611: mol_type = other RNA
atggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactga

SEQ ID NO: 19111 - RNA, 1611 nt, synthetic construct
  misc_feature 1..1611: note = derived and/or modified CDS sequence (opt4) from HRSV(Memphis-37)__AIY60640.1__F_DSCav1_mut8
  source 1..1611: mol_type = other RNA
atggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactga

SEQ ID NO: 19112 - RNA, 1611 nt, synthetic construct
  misc_feature 1..1611: note = derived and/or modified CDS sequence (opt5) from HRSV(Memphis-37)__AIY60640.1__F_DSCav1_mut8
  source 1..1611: mol_type = other RNA
atggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactga

SEQ ID NO: 19113 - RNA, 1611 nt, synthetic construct
  misc_feature 1..1611: note = derived and/or modified CDS sequence (opt6) from HRSV(Memphis-37)__AIY60640.1__F_DSCav1_mut8
  source 1..1611: mol_type = other RNA
atggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaa

SEQ ID NO: 19114 - RNA, 1611 nt, synthetic construct
  misc_feature 1..1611: note = derived and/or modified CDS sequence (opt11) from HRSV(Memphis-37)__AIY60640.1__F_DSCav1_mut8
  source 1..1611: mol_type = other RNA
atggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaa

SEQ ID NO: 19115 - RNA, 1887 nt, synthetic construct
  misc_feature 1..1887: note = mRNA product Design a-1 comprising derived and/or modified sequence from HRSV(Memphis-37)__AIY60640.1__F_DSCav1_mut8 (opt1)
  source 1..1887: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19116 - RNA, 1887 nt, synthetic construct
  misc_feature 1..1887: note = mRNA product Design a-1 comprising derived and/or modified sequence from HRSV(Memphis-37)__AIY60640.1__F_DSCav1_mut8 (opt1)
  source 1..1887: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19117 - RNA, 1887 nt, synthetic construct
  misc_feature 1..1887: note = mRNA product Design a-1 comprising derived and/or modified sequence from HRSV(Memphis-37)__AIY60640.1__F_DSCav1_mut8 (opt2)
  source 1..1887: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19118 - RNA, 1887 nt, synthetic construct
  misc_feature 1..1887: note = mRNA product Design a-1 comprising derived and/or modified sequence from HRSV(Memphis-37)__AIY60640.1__F_DSCav1_mut8 (opt3)
  source 1..1887: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19119 - RNA, 1887 nt, synthetic construct
  misc_feature 1..1887: note = mRNA product Design a-1 comprising derived and/or modified sequence from HRSV(Memphis-37)__AIY60640.1__F_DSCav1_mut8 (opt4)
  source 1..1887: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19120 - RNA, 1887 nt, synthetic construct
  misc_feature 1..1887: note = mRNA product Design a-1 comprising derived and/or modified sequence from HRSV(Memphis-37)__AIY60640.1__F_DSCav1_mut8 (opt5)
  source 1..1887: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19121 - RNA, 1887 nt, synthetic construct
  misc_feature 1..1887: note = mRNA product Design a-1 comprising derived and/or modified sequence from HRSV(Memphis-37)__AIY60640.1__F_DSCav1_mut8 (opt6)
  source 1..1887: mol_type = other RNA
gggagagtcccgcagtcggcgtccagcggctctgcttgttcgtgtgtgtgtcgttgcaggccttattcaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19122 - RNA, 1887 nt, synthetic construct
  misc_feature 1..1887: note = mRNA product Design a-1 comprising derived and/or modified sequence from HRSV(Memphis-37)__AIY60640.1__F_DSCav1_mut8 (opt11)
  source 1..1887: mol_type = other RNA
gggagagtcccgcagtcggcgtccagcggctctgcttgttcgtgtgtgtgtcgttgcaggccttattcaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19123 - RNA, 1906 nt, synthetic construct
  misc_feature 1..1906: note = mRNA product Design a-2 comprising derived and/or modified sequence from HRSV(Memphis-37)__AIY60640.1__F_DSCav1_mut8 (opt1)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19124 - RNA, 1906 nt, synthetic construct
  misc_feature 1..1906: note = mRNA product Design a-2 comprising derived and/or modified sequence from HRSV(Memphis-37)__AIY60640.1__F_DSCav1_mut8 (opt1)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19125 - RNA, 1906 nt, synthetic construct
  misc_feature 1..1906: note = mRNA product Design a-2 comprising derived and/or modified sequence from HRSV(Memphis-37)__AIY60640.1__F_DSCav1_mut8 (opt2)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19126 - RNA, 1906 nt, synthetic construct
  misc_feature 1..1906: note = mRNA product Design a-2 comprising derived and/or modified sequence from HRSV(Memphis-37)__AIY60640.1__F_DSCav1_mut8 (opt3)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19127 - RNA, 1906 nt, synthetic construct
  misc_feature 1..1906: note = mRNA product Design a-2 comprising derived and/or modified sequence from HRSV(Memphis-37)__AIY60640.1__F_DSCav1_mut8 (opt4)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19128 - RNA, 1906 nt, synthetic construct
  misc_feature 1..1906: note = mRNA product Design a-2 comprising derived and/or modified sequence from HRSV(Memphis-37)__AIY60640.1__F_DSCav1_mut8 (opt5)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19129 - RNA, 1906 nt, synthetic construct
  misc_feature 1..1906: note = mRNA product Design a-2 comprising derived and/or modified sequence from HRSV(Memphis-37)__AIY60640.1__F_DSCav1_mut8 (opt6)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19130 - RNA, 1906 nt, synthetic construct
  misc_feature 1..1906: note = mRNA product Design a-2 comprising derived and/or modified sequence from HRSV(Memphis-37)__AIY60640.1__F_DSCav1_mut8 (opt11)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19131 - RNA, 1984 nt, synthetic construct
  misc_feature 1..1984: note = mRNA product Design a-3 comprising derived and/or modified sequence from HRSV(Memphis-37)__AIY60640.1__F_DSCav1_mut8 (opt1)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19132 - RNA, 1984 nt, synthetic construct
  misc_feature 1..1984: note = mRNA product Design a-3 comprising derived and/or modified sequence from HRSV(Memphis-37)__AIY60640.1__F_DSCav1_mut8 (opt1)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19133 - RNA, 1984 nt, synthetic construct
  misc_feature 1..1984: note = mRNA product Design a-3 comprising derived and/or modified sequence from HRSV(Memphis-37)__AIY60640.1__F_DSCav1_mut8 (opt2)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19134 - RNA, 1984 nt, synthetic construct
  misc_feature 1..1984: note = mRNA product Design a-3 comprising derived and/or modified sequence from HRSV(Memphis-37)__AIY60640.1__F_DSCav1_mut8 (opt3)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19135 - RNA, 1984 nt, synthetic construct
  misc_feature 1..1984: note = mRNA product Design a-3 comprising derived and/or modified sequence from HRSV(Memphis-37)__AIY60640.1__F_DSCav1_mut8 (opt4)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19136 - RNA, 1984 nt, synthetic construct
  misc_feature 1..1984: note = mRNA product Design a-3 comprising derived and/or modified sequence from HRSV(Memphis-37)__AIY60640.1__F_DSCav1_mut8 (opt5)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19137 - RNA, 1984 nt, synthetic construct
  misc_feature 1..1984: note = mRNA product Design a-3 comprising derived and/or modified sequence from HRSV(Memphis-37)__AIY60640.1__F_DSCav1_mut8 (opt6)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19138 - RNA, 1984 nt, synthetic construct
  misc_feature 1..1984: note = mRNA product Design a-3 comprising derived and/or modified sequence from HRSV(Memphis-37)__AIY60640.1__F_DSCav1_mut8 (opt11)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19139 - RNA, 1933 nt, synthetic construct
  misc_feature 1..1933: note = mRNA product Design a-4 comprising derived and/or modified sequence from HRSV(Memphis-37)__AIY60640.1__F_DSCav1_mut8 (opt1)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19140 - RNA, 1933 nt, synthetic construct
  misc_feature 1..1933: note = mRNA product Design a-4 comprising derived and/or modified sequence from HRSV(Memphis-37)__AIY60640.1__F_DSCav1_mut8 (opt1)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19141 - RNA, 1933 nt, synthetic construct
  misc_feature 1..1933: note = mRNA product Design a-4 comprising derived and/or modified sequence from HRSV(Memphis-37)__AIY60640.1__F_DSCav1_mut8 (opt2)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19142 - RNA, 1933 nt, synthetic construct
  misc_feature 1..1933: note = mRNA product Design a-4 comprising derived and/or modified sequence from HRSV(Memphis-37)__AIY60640.1__F_DSCav1_mut8 (opt3)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19143 - RNA, 1933 nt, synthetic construct
  misc_feature 1..1933: note = mRNA product Design a-4 comprising derived and/or modified sequence from HRSV(Memphis-37)__AIY60640.1__F_DSCav1_mut8 (opt4)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19144 - RNA, 1933 nt, synthetic construct
  misc_feature 1..1933: note = mRNA product Design a-4 comprising derived and/or modified sequence from HRSV(Memphis-37)__AIY60640.1__F_DSCav1_mut8 (opt5)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19145 - RNA, 1933 nt, synthetic construct
  misc_feature 1..1933: note = mRNA product Design a-4 comprising derived and/or modified sequence from HRSV(Memphis-37)__AIY60640.1__F_DSCav1_mut8 (opt6)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19146 - RNA, 1933 nt, synthetic construct
  misc_feature 1..1933: note = mRNA product Design a-4 comprising derived and/or modified sequence from HRSV(Memphis-37)__AIY60640.1__F_DSCav1_mut8 (opt11)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19147 - RNA, 1879 nt, synthetic construct
  misc_feature 1..1879: note = mRNA product Design a-5 comprising derived and/or modified sequence from HRSV(Memphis-37)__AIY60640.1__F_DSCav1_mut8 (opt1)
  source 1..1879: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19148 - RNA, 1879 nt, synthetic construct
  misc_feature 1..1879: note = mRNA product Design a-5 comprising derived and/or modified sequence from HRSV(Memphis-37)__AIY60640.1__F_DSCav1_mut8 (opt1)
  source 1..1879: mol_type = other RNA
gggagactttcccattctgtagcagaatttggtgttgcctgtggtcttggtcccgcggagaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19149 - RNA, 1879 nt, synthetic construct
  misc_feature 1..1879: note = mRNA product Design a-5 comprising derived and/or modified sequence from HRSV(Memphis-37)__AIY60640.1__F_DSCav1_mut8 (opt2)
  source 1..1879: mol_type = other RNA
gggagactttcccattctgtagcagaatttggtgttgcctgtggtcttggtcccgcggagaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19150 - RNA, 1879 nt, synthetic construct
  misc_feature 1..1879: note = mRNA product Design a-5 comprising derived and/or modified sequence from HRSV(Memphis-37)__AIY60640.1__F_DSCav1_mut8 (opt3)
  source 1..1879: mol_type = other RNA
gggagactttcccattctgtagcagaatttggtgttgcctgtggtcttggtcccgcggagaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19151 - RNA, 1879 nt, synthetic construct
  misc_feature 1..1879: note = mRNA product Design a-5 comprising derived and/or modified sequence from HRSV(Memphis-37)__AIY60640.1__F_DSCav1_mut8 (opt4)
  source 1..1879: mol_type = other RNA
gggagactttcccattctgtagcagaatttggtgttgcctgtggtcttggtcccgcggagaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19152 - RNA, 1879 nt, synthetic construct
  misc_feature 1..1879: note = mRNA product Design a-5 comprising derived and/or modified sequence from HRSV(Memphis-37)__AIY60640.1__F_DSCav1_mut8 (opt5)
  source 1..1879: mol_type = other RNA
gggagactttcccattctgtagcagaatttggtgttgcctgtggtcttggtcccgcggagaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19153 - RNA, 1879 nt, synthetic construct
  misc_feature 1..1879: note = mRNA product Design a-5 comprising derived and/or modified sequence from HRSV(Memphis-37)__AIY60640.1__F_DSCav1_mut8 (opt6)
  source 1..1879: mol_type = other RNA
gggagactttcccattctgtagcagaatttggtgttgcctgtggtcttggtcccgcggagaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19154 - RNA, 1879 nt, synthetic construct
  misc_feature 1..1879: note = mRNA product Design a-5 comprising derived and/or modified sequence from HRSV(Memphis-37)__AIY60640.1__F_DSCav1_mut8 (opt11)
  source 1..1879: mol_type = other RNA
gggagactttcccattctgtagcagaatttggtgttgcctgtggtcttggtcccgcggagaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19155 - RNA, 2060 nt, synthetic construct
  misc_feature 1..2060: note = mRNA product Design b-1 comprising derived and/or modified sequence from HRSV(Memphis-37)__AIY60640.1__F_DSCav1_mut8 (opt1)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19156 - RNA, 2060 nt, synthetic construct
  misc_feature 1..2060: note = mRNA product Design b-1 comprising derived and/or modified sequence from HRSV(Memphis-37)__AIY60640.1__F_DSCav1_mut8 (opt1)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19157 - RNA, 2060 nt, synthetic construct
  misc_feature 1..2060: note = mRNA product Design b-1 comprising derived and/or modified sequence from HRSV(Memphis-37)__AIY60640.1__F_DSCav1_mut8 (opt2)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19158 - RNA, 2060 nt, synthetic construct
  misc_feature 1..2060: note = mRNA product Design b-1 comprising derived and/or modified sequence from HRSV(Memphis-37)__AIY60640.1__F_DSCav1_mut8 (opt3)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19159 - RNA, 2060 nt, synthetic construct
  misc_feature 1..2060: note = mRNA product Design b-1 comprising derived and/or modified sequence from HRSV(Memphis-37)__AIY60640.1__F_DSCav1_mut8 (opt4)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19160 - RNA, 2060 nt, synthetic construct
  misc_feature 1..2060: note = mRNA product Design b-1 comprising derived and/or modified sequence from HRSV(Memphis-37)__AIY60640.1__F_DSCav1_mut8 (opt5)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19161 - RNA, 2060 nt, synthetic construct
  misc_feature 1..2060: note = mRNA product Design b-1 comprising derived and/or modified sequence from HRSV(Memphis-37)__AIY60640.1__F_DSCav1_mut8 (opt6)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19162 - RNA, 2060 nt, synthetic construct
  misc_feature 1..2060: note = mRNA product Design b-1 comprising derived and/or modified sequence from HRSV(Memphis-37)__AIY60640.1__F_DSCav1_mut8 (opt11)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19163 - RNA, 1880 nt, synthetic construct
  misc_feature 1..1880: note = mRNA product Design b-2 comprising derived and/or modified sequence from HRSV(Memphis-37)__AIY60640.1__F_DSCav1_mut8 (opt1)
  source 1..1880: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19164 - RNA, 1880 nt, synthetic construct
  misc_feature 1..1880: note = mRNA product Design b-2 comprising derived and/or modified sequence from HRSV(Memphis-37)__AIY60640.1__F_DSCav1_mut8 (opt1)
  source 1..1880: mol_type = other RNA
gggagagcctctgctggagtccggggagtggcgttggctgctagagcgaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19165 - RNA, 1880 nt, synthetic construct
  misc_feature 1..1880: note = mRNA product Design b-2 comprising derived and/or modified sequence from HRSV(Memphis-37)__AIY60640.1__F_DSCav1_mut8 (opt2)
  source 1..1880: mol_type = other RNA
gggagagcctctgctggagtccggggagtggcgttggctgctagagcgaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19166 - RNA, 1880 nt, synthetic construct
  misc_feature 1..1880: note = mRNA product Design b-2 comprising derived and/or modified sequence from HRSV(Memphis-37)__AIY60640.1__F_DSCav1_mut8 (opt3)
  source 1..1880: mol_type = other RNA
gggagagcctctgctggagtccggggagtggcgttggctgctagagcgaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19167 - RNA, 1880 nt, synthetic construct
  misc_feature 1..1880: note = mRNA product Design b-2 comprising derived and/or modified sequence from HRSV(Memphis-37)__AIY60640.1__F_DSCav1_mut8 (opt4)
  source 1..1880: mol_type = other RNA
gggagagcctctgctggagtccggggagtggcgttggctgctagagcgaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19168 - RNA, 1880 nt, synthetic construct
  misc_feature 1..1880: note = mRNA product Design b-2 comprising derived and/or modified sequence from HRSV(Memphis-37)__AIY60640.1__F_DSCav1_mut8 (opt5)
  source 1..1880: mol_type = other RNA
gggagagcctctgctggagtccggggagtggcgttggctgctagagcgaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19169 - RNA, 1880 nt, synthetic construct
  misc_feature 1..1880: note = mRNA product Design b-2 comprising derived and/or modified sequence from HRSV(Memphis-37)__AIY60640.1__F_DSCav1_mut8 (opt6)
  source 1..1880: mol_type = other RNA
gggagagcctctgctggagtccggggagtggcgttggctgctagagcgaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19170 - RNA, 1880 nt, synthetic construct
  misc_feature 1..1880: note = mRNA product Design b-2 comprising derived and/or modified sequence from HRSV(Memphis-37)__AIY60640.1__F_DSCav1_mut8 (opt11)
  source 1..1880: mol_type = other RNA
gggagagcctctgctggagtccggggagtggcgttggctgctagagcgaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19171 - RNA, 1900 nt, synthetic construct
  misc_feature 1..1900: note = mRNA product Design b-3 comprising derived and/or modified sequence from HRSV(Memphis-37)__AIY60640.1__F_DSCav1_mut8 (opt1)
  source 1..1900: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19172 - RNA, 1900 nt, synthetic construct
  misc_feature 1..1900: note = mRNA product Design b-3 comprising derived and/or modified sequence from HRSV(Memphis-37)__AIY60640.1__F_DSCav1_mut8 (opt1)
  source 1..1900: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19173 - RNA, 1900 nt, synthetic construct
  misc_feature 1..1900: note = mRNA product Design b-3 comprising derived and/or modified sequence from HRSV(Memphis-37)__AIY60640.1__F_DSCav1_mut8 (opt2)
  source 1..1900: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19174 - RNA, 1900 nt, synthetic construct
  misc_feature 1..1900: note = mRNA product Design b-3 comprising derived and/or modified sequence from HRSV(Memphis-37)__AIY60640.1__F_DSCav1_mut8 (opt3)
  source 1..1900: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19175 - RNA, 1900 nt, synthetic construct
  misc_feature 1..1900: note = mRNA product Design b-3 comprising derived and/or modified sequence from HRSV(Memphis-37)__AIY60640.1__F_DSCav1_mut8 (opt4)
  source 1..1900: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19176 - RNA, 1900 nt, synthetic construct
  misc_feature 1..1900: note = mRNA product Design b-3 comprising derived and/or modified sequence from HRSV(Memphis-37)__AIY60640.1__F_DSCav1_mut8 (opt5)
  source 1..1900: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19177 - RNA, 1900 nt, synthetic construct
  misc_feature 1..1900: note = mRNA product Design b-3 comprising derived and/or modified sequence from HRSV(Memphis-37)__AIY60640.1__F_DSCav1_mut8 (opt6)
  source 1..1900: mol_type = other RNA
gggagagtcccgcagtcggcgtccagcggctctgcttgttcgtgtgtgtgtcgttgcaggccttattcaagcttaccatggaacttcctattttaaaaacaaacgcaattacaaccatattagcagcagtaacactatgctttgcatcatcacaaaacatcaccgaagaattttatcaatccacatgctcagcagtatcaaaaggataccttggcgcactccgaacaggctggtatacatcggtcataactatagaactctccaacataaaagaaataaaatgcaatggtactgacgcaaaagtaaaattaataaaacaagaactagacaaatacaaaaacgcagtaaccgatttacaactacttatgcaatcaacacctgcagcaggaagcggatcagcaatagcaagtggaatagcagtatgcaaagtacttcacctcgaaggagaagtaaataaaataaaaaacgccttactatcaacaaataaagccgtcgtatcactttccggttgcggcgtatcagtattaacctttaaagtcttagacttaaaaaactacatagacaaacaattattaccaatactaaacaaacaatcctgttccatacccaacatagaaaccgtaatagaatttcaacaaaaaaacaacagactattagaaataacacgcgaattttcagtaaacgcaggcgtaacaacaccagtatcaacatatatgttaaccaattcagaattattatcccttataaatgacatgcctataacaaacgaccaaaaaaaattaatgagtaacaacgttcaaatagtaagacaacaatcatacagcataatgtgcataataaaagaagaagtactagcatacgtagttcaactaccactctatggcgttatcgacaccccatgctggaaactacatacctcaccactctgtaccactaatacgaaagaaggatctaacatatgcctaaccagaacagatcgaggttggtattgcgacaatgctggatcagtatcattcttcccacaagcagaaacctgcaaagtacaaagcaacagagtattttgtgacactatgaactcactaacgctaccttcagaagtaaacctatgcaacatcgacatattcaacccaaaatacgattgcaaaataatgacatcaaaaacagacgtttcctcatcagtaataacatcattaggagcaatagtatcctgctacggtaaaaccaaatgcacagcatccaataaatgccgaggaatcattaaaacattttcaaatggctgcgactatgtaagtaataaaggtgtagatacagtatcagtaggcaacacactatattacgtaaacaaacaagaagggcaatccctatatgtcaaaggcgaaccaattataaacttctacgaccccctcgtattcccatcagacgaatttgacgcatcaatatcccaagtaaacgaaaaaatcaaccaatcactcgcattcatacgtaaatccgacgaattactacataacgtaaacgtaggcaaatcaacaacaaatataatgataacaaccataatcatagtaataatagttatactcctactactcattgcagtcggcctatttctatactgtaaagcacgctctacaccagtaacactatctaaagatcaattatccggaataaacaacattgccttctccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19178 - RNA, 1900 nt, synthetic construct
  misc_feature 1..1900: note = mRNA product Design b-3 comprising derived and/or modified sequence from HRSV(Memphis-37)__AIY60640.1__F_DSCav1_mut8 (opt11)
  source 1..1900: mol_type = other RNA
gggagagtcccgcagtcggcgtccagcggctctgcttgttcgtgtgtgtgtcgttgcaggccttattcaagcttaccatggaacttcccatcctgaagaccaacgctatcacaaccatcctcgccgcagtcaccctttgcttcgcctcatcccaaaacatcaccgaagaattttaccagtcaacctgctcggccgtctccaagggctacctcggcgccctccgcactggctggtacacatccgtcatcaccatcgaactctccaacataaaagaaataaaatgcaacggaaccgacgccaaagtcaaactcatcaaacaagaactagataaatataaaaacgccgtcaccgacctgcaactcctcatgcaatccaccccagccgccggctctggcagcgccatcgcaagcggaatcgccgtctgcaaagtcctccacctagaaggcgaagtcaacaaaattaaaaacgccctcctctccaccaacaaagcagttgtctccctctctggctgcggagtctctgtactcaccttcaaagtactagacctcaagaattacatagacaaacaactcctgcccatccttaacaaacaaagttgtagtatccccaacatcgaaacagtaatcgaatttcagcagaaaaacaaccgcctcctcgaaatcacacgagagttctcggtcaacgccggcgtcaccacccccgtatcaacctacatgctaacaaactccgaactactttccctcatcaatgacatgcccataaccaacgaccaaaagaaactaatgtccaataacgtccagatagtccgtcaacagtcctactcaatcatgtgcataattaaagaagaagtactcgcctacgtcgtccaactacccctctatggagtcatcgacaccccctgctggaaactccacacatcacccctatgcacaaccaacaccaaagaaggctccaacatctgcctcacaagaaccgaccgcggctggtactgcgacaacgctggctccgtctcgttcttcccacaagccgaaacctgcaaagtccaatcaaaccgggtcttctgcgacaccatgaactccctcactctcccaagcgaagtcaacctatgcaacatcgacatcttcaacccaaaatacgactgtaaaatcatgacttcgaaaacagacgtctcctcatcagtaatcacatccttaggcgccatcgtgtcctgctacggtaagaccaaatgcacagcctccaacaaatgccggggcatcatcaaaaccttcagcaacggttgtgattacgtctccaacaaaggagtagacaccgtctccgtaggaaacaccctctactacgtcaacaagcaagaaggccaatccctctacgtcaaaggggaacccatcatcaacttctacgacccactcgtcttcccctccgacgagttcgacgcaagcatctcccaagtcaacgaaaagatcaaccaatcactagccttcatccgcaaatccgacgaactcctccacaacgttaacgtaggcaaatccaccaccaacatcatgatcacaaccatcatcatagtcataatagtcatcctactactcctcatcgccgtaggtctattcctatactgtaaagctcgatcaacccccgtcacactctccaaagatcaactctcaggaatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19179 - RNA, 1951 nt, synthetic construct
  misc_feature 1..1951: note = mRNA product Design b-4 comprising derived and/or modified sequence from HRSV(Memphis-37)__AIY60640.1__F_DSCav1_mut8 (opt1)
  source 1..1951: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcaccccggccgccggctccgggagcgcgatcgcctccggcatcgccgtctgcaaggtgctgcacctcgagggcgaggtgaacaagatcaagaacgccctgctgtccaccaacaaggccgtcgtgagcctctccggctgcggggtgagcgtcctgaccttcaaggtgctggacctcaagaactacatcgacaagcagctgctgcccatcctgaacaagcagagctgctccatccccaacatcgagaccgtcatcgagttccagcagaagaacaaccgcctcctggagatcacgcgggagttcagcgtgaacgcgggcgtgaccacccccgtctccacctacatgctgacgaacagcgagctcctgtccctgatcaacgacatgccgatcaccaacgaccagaagaagctcatgagcaacaacgtgcagatcgtgcgccagcagtcctacagcatcatgtgcatcatcaaggaggaggtcctggcctacgtggtgcagctgcccctctacggggtcatcgacaccccctgctggaagctgcacaccagccccctgtgcacgaccaacaccaaggagggctccaacatctgcctcacccggacggaccgcgggtggtactgcgacaacgccggcagcgtgtccttcttcccgcaggccgagacctgcaaggtccagagcaaccgggtgttctgcgacaccatgaactccctgaccctgcccagcgaggtgaacctctgcaacatcgacatcttcaaccccaagtacgactgcaagatcatgacgtccaagaccgacgtcagctccagcgtgatcacctccctgggcgccatcgtgagctgctacgggaagaccaagtgcacggcgagcaacaagtgccgcggcatcatcaagaccttctccaacgggtgcgactacgtcagcaacaagggcgtggacaccgtgtccgtcggcaacaccctgtactacgtgaacaagcaggagggccagagcctctacgtgaagggggagcccatcatcaacttctacgacccgctggtcttcccctccgacgagttcgacgccagcatctcccaggtgaacgagaagatcaaccagagcctggccttcatccggaagtccgacgagctcctgcacaacgtgaacgtcggcaagagcaccacgaacatcatgatcaccaccatcatcatcgtgatcatcgtgatcctgctgctcctgatcgccgtcgggctgttcctctactgcaaggcccgctccacccccgtgacgctgagcaaggaccagctgtccgggatcaacaacatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19180 - RNA, 1951 nt, synthetic construct
  misc_feature 1..1951: note = mRNA product Design b-4 comprising derived and/or modified sequence from HRSV(Memphis-37)__AIY60640.1__F_DSCav1_mut8 (opt1)
  source 1..1951: mol_type = other RNA
gggagagtcccgcagtcggcgtccagcggctctgcttgttcgtgtgtgtgtcgttgcaggccttattcaagcttaccatggagctgcccatcctcaagaccaacgccatcaccacgatcctggccgcggtgaccctgtgcttcgccagctcccagaacatcaccgaggagttctaccagagcacgtgctccgccgtcagcaagggctacctcggggccctgcgcaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggccgccggcagcgggtccgccatcgcgagcggcatcgccgtgtgcaaggtgctgcacctcgagggcgaggtcaacaagatcaagaacgccctgctgtccaccaacaaggccgtggtgagcctctccgggtgcggcgtcagcgtgctgaccttcaaggtgctggacctcaagaactacatcgacaagcagctgctgcccatcctcaacaagcagtcctgcagcatccccaacatcgagacggtcatcgagttccagcagaagaacaaccggctgctggagatcacccgcgagttctccgtgaacgccggggtgaccacccccgtcagcacgtacatgctcaccaactccgagctgctgagcctcatcaacgacatgccgatcaccaacgaccagaagaagctgatgagcaacaacgtgcagatcgtgcggcagcagtcctacagcatcatgtgcatcatcaaggaggaggtcctggcgtacgtggtgcagctccccctgtacggcgtcatcgacaccccctgctggaagctgcacacgagccccctctgcaccaccaacaccaaggaggggtccaacatctgcctgacgcgcaccgaccggggctggtactgcgacaacgccggctccgtgagcttcttcccgcaggccgagacctgcaaggtgcagtccaaccgcgtcttctgcgacaccatgaacagcctgacgctcccctccgaggtgaacctgtgcaacatcgacatcttcaaccccaagtacgactgcaagatcatgaccagcaagaccgacgtctccagctccgtgatcaccagcctgggggccatcgtgtcctgctacggcaagacgaagtgcaccgccagcaacaagtgccgggggatcatcaagaccttctccaacggctgcgactacgtcagcaacaagggcgtggacaccgtgtccgtcgggaacacgctctactacgtgaacaagcaggagggccagagcctgtacgtgaagggggagcccatcatcaacttctacgacccgctggtcttccccagcgacgagttcgacgcgtccatcagccaggtgaacgagaagatcaaccagtccctcgccttcatccgcaagagcgacgagctgctgcacaacgtgaacgtcggcaagtccaccaccaacatcatgatcaccaccatcatcatcgtgatcatcgtgatcctcctgctgctcatcgccgtcgggctgttcctgtactgcaaggcccggagcacgcccgtgaccctgtccaaggaccagctcagcggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19181 - RNA, 1951 nt, synthetic construct
  misc_feature 1..1951: note = mRNA product Design b-4 comprising derived and/or modified sequence from HRSV(Memphis-37)__AIY60640.1__F_DSCav1_mut8 (opt2)
  source 1..1951: mol_type = other RNA
gggagagtcccgcagtcggcgtccagcggctctgcttgttcgtgtgtgtgtcgttgcaggccttattcaagcttaccatggagctccccatcctcaagaccaacgccatcaccaccatcctcgccgccgtcaccctctgcttcgcctcctcccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccgccggctccggctccgccatcgcctccggcatcgccgtctgcaaggtcctccacctcgagggcgaggtcaacaagatcaagaacgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacatcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgtcggcaagtccaccaccaacatcatgatcaccaccatcatcatcgtcatcatcgtcatcctcctcctcctcatcgccgtcggcctcttcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19182 - RNA, 1951 nt, synthetic construct
  misc_feature 1..1951: note = mRNA product Design b-4 comprising derived and/or modified sequence from HRSV(Memphis-37)__AIY60640.1__F_DSCav1_mut8 (opt3)
  source 1..1951: mol_type = other RNA
gggagagtcccgcagtcggcgtccagcggctctgcttgttcgtgtgtgtgtcgttgcaggccttattcaagcttaccatggagctgcccatcctcaagaccaacgccattacaactatacttgctgcagtgacgctgtgcttcgccagctcccagaatatcaccgaagagttttaccaatctacatgttcagcggtcagtaaaggctatttgggggctttaagaactggatggtacaccagcgttattacaatcgaactgtccaacattaaggagatcaaatgcaatggtaccgacgccaaggtgaaactaataaagcaggaactcgataagtataaaaacgcagtaactgacctgcagcttctgatgcagtctactcctgccgctggctcggggtcagcaatcgccagcggaattgctgtgtgtaaggtcttgcacctcgagggcgaggtgaataaaatcaagaacgccctgctgagtaccaataaagcggttgtgtccctctctggttgcggggtcagcgtgttaacgttcaaggtactggatcttaagaactacattgacaaacaattgctgccaatcctaaataagcagtcctgttcaataccgaacattgaaactgttatcgagtttcagcagaaaaataacaggctcctggaaattacccgggagttcagtgtgaatgcaggagtcacaactcccgtgagcacctatatgcttacaaactctgagctgttgtccctcatcaatgatatgcctatcaccaacgaccaaaagaaactgatgtcaaacaatgtgcagattgtccgccagcagagctacagtataatgtgcatcattaaggaagaggttttagcctatgtggtacaactgccactctacggcgtgatcgatacgccctgttggaaacttcatacttctcctctgtgcacaaccaacactaaggaaggctccaatatatgtttgacacgaaccgaccgtgggtggtactgcgataacgctggaagcgtctcgtttttcccacaggccgagacgtgtaaggtgcagtctaatagagttttctgcgacaccatgaactccctaacactgccctcagaagtgaatctctgcaacattgatatcttcaatcctaaatatgactgtaagatcatgacaagtaaaaccgatgtcagctcctctgtgattacaagcctgggtgcaatcgtatcatgctacggcaagactaaatgtaccgctagtaacaagtgcagggggattataaagacattttccaatggatgtgactatgttagcaacaaaggcgtggacaccgtctctgtgggtaatactctttactatgtcaacaagcaagaggggcagtcactgtacgtgaaaggagagccaatcattaatttctatgatccgttggtttttcccagtgacgaatttgatgccagcatctcccaggtgaacgagaagatcaaccagtctctcgcgtttattcggaaatcggacgaactgttacacaatgtaaacgtcggcaagagcacgacaaatataatgatcaccactattatcattgtgatcatagttatcctgctactcctgattgccgtgggccttttcttgtactgcaaggcacgctccacccctgtcacactgtcaaaagatcaactcagtgggatcaacaatattgctttctctaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19183 - RNA, 1951 nt, synthetic construct
  misc_feature 1..1951: note = mRNA product Design b-4 comprising derived and/or modified sequence from HRSV(Memphis-37)__AIY60640.1__F_DSCav1_mut8 (opt4)
  source 1..1951: mol_type = other RNA
gggagagtcccgcagtcggcgtccagcggctctgcttgttcgtgtgtgtgtcgttgcaggccttattcaagcttaccatggagctgcccatcctgaagaccaacgccatcaccaccatcctggccgccgtgaccctgtgcttcgccagcagccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccgccggcagcggcagcgccatcgccagcggcatcgccgtgtgcaaggtgctgcacctggagggcgaggtgaacaagatcaagaacgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacatcgacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgtgggcaagagcaccaccaacatcatgatcaccaccatcatcatcgtgatcatcgtgatcctgctgctgctgatcgccgtgggcctgttcctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 19184 - RNA, 1951 nt, synthetic construct
  misc_feature 1..1951: note = mRNA product Design b-4 comprising derived and/or modified sequence from HRSV(Memphis-37)__AIY60640.1__F_DSCav1_mut8 (opt5)
  source 1..1951: mol_type = other RNA
gggagagtcccgcagtcggcgtccagcggctctgcttgttcgtgtgtgtgtcgttgcaggccttattcaagcttaccatggagctgcccatcctcaagaccaacgccattacaacgatcctggctgccgtgaccctttgcttcgcgagctcccagaatattacagaagagttttaccaatctacctgtagcgctgtctccaaaggctatctgggggccctcagaacaggatggtacacctctgttatcacaattgaactgagcaacatcaaggagatcaaatgcaatggcaccgacgccaaggtgaaacttattaagcaggaactggataagtataaaaacgctgtgacggacctccagctgctgatgcagtccacccctgccgctgggtctggaagcgccatcgcgtccggcattgccgtctgtaaggtgctccacctggagggggaggttaataaaatcaagaacgcccttctgagcacaaataaagctgtggtctctctctccggatgcggcgtgagcgttctgaccttcaaggtgcttgatctgaagaactacattgacaaacaactcctgccgatcctgaataagcagtcttgttccattcccaacatcgaaacagtcatcgagtttcagcagaaaaataaccggctcctggaaattacccgcgagttcagcgtgaatgctggcgtgacgacacctgtctctacctatatgcttacaaactccgagctgctcagcctgatcaatgatatgcccattaccaacgaccaaaagaaacttatgtccaacaatgttcagatcgtgagacagcagtcttacagcattatgtgcatcatcaaggaagaggtgctggcctatgtcgtgcaactccctctgtacggggttattgataccccctgttggaaactgcatacatcccctctctgcacgaccaacacaaaggaaggaagcaatatctgtctgacccggacagaccgcggctggtactgcgataacgcggggtctgtgtcctttttcccgcaggccgagacctgtaaggtccagagcaatagagtgttttgcgacacgatgaactctcttacactgcccagcgaagttaatctctgcaacattgatatcttcaatcctaaatatgactgtaagattatgacctccaaaaccgatgtgtctagctccgtcatcacaagcctgggagctatcgtgtcttgctacggcaagaccaaatgtacagcctccaacaagtgccgggggattatcaagacgtttagcaatggatgtgactatgtctctaacaaaggcgtggacaccgtttccgtgggcaatacactttactatgtcaacaagcaagaggggcagagcctgtacgtgaaaggagagcccattatcaatttctatgatcctctcgtttttccctccgacgagttcgatgcttctattagccaggtgaacgaaaagatcaaccagtccctggcctttattcgcaaatctgacgaactgctccacaatgtcaacgtgggcaagagcaccacaaatatcatgatcaccacgattatcattgtgatcattgttatcctgcttctgctcatcgccgtcgggctgttcctgtactgcaaggctagatccaccccggtgacacttagcaaagatcaactctctggaattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt
